United States Patent 7,745,391 (HUMAN THROMBOSPONDIN POLYPEPTIDE) - sequence listing, part 143

SEQ ID NO: 375187 - DNA, 1290 bp, Homo sapiens
ttctaatcacaaggaagatggagaaaatgcagaacaagtggtcaagaacagggagataataaatagaatatttatgggctgaggaaaacaattaccaggggaaagcccaagaagcaaagatgaacagagaacgtgctgactgcgctcgtttggaaaggcctcatggccaaaggaggagaggcattatgaggagcagtgaccgagtgggcaggacccccggggatcaggaaaggtgcacggggggagatgagaggcctgagcggcttcccaccgaaggtttttgaagcacggtttgattttctctctccccctcaccatccccagattttagttgtgactatctccaggtacatggcttgcgacaggcggtgtataaaaactaatgtgagtttaattttaaaaccttagccattttctggaacttaaatatcaaagagaaaatgtccacatatgatgttaattgaggtttgtctcactggtgatttgtgctgattcaattcctgtttctttttttttttcttaaggggtcagttttagaattgggagataggtgtataacatatgactatacagcgcaggttggttttttaacatagaaatatctgcccttaaatgagaactgaaaacggagcttcttggaggccacctgctggtggcagtgatctgaccgctgtttaagctttctttgaactcctttttttaaaacagcctccataatcaatggtgtacgatctactctcgtggtaaaacttactcagtgaagagtgtgttttattttctgaggagctgaactgttccaacctgagtattctgaataaggacagtggtcgagcatgagtgatgccatctgggcttagaaataagtgggcctaaaatctgattgttttcatacattgttcagatattgacgcaaatagcaatttattttgtaaaaaatgattggtatccggaacttgcaacagctgtgtgtggcttgaagggagatgaagtggtgaaggcctggtttccaccgaagctctcacagcccagcctttcactgtgtggccgggggaagggtgctccgggtgggggacgggaatggtgggaatggggatgccacgggacaaggctgctggcctggaaggtagtcacgtggagaaccgcaggagatgagattggaaagtagtaataagccatgtggataagaacagaggagcgggttttaaggggacgtcctgaaatgctgctcatgtcgtttcagttccatagaccacaggaaatgcaggtgagagggcacccggtggagaagga

SEQ ID NO: 375188 - DNA, 412 bp, Homo sapiens
cccctccctcttccccctcctgtctcaaaccctccaatgtaaacttcagtctcaccttaaatgtcacttcctctggagcccttttcatggtccctggtttaaatttagtccatacagcaaactgtgattgtcctccaaaccacttcaaagaactgtaatcatttaattatctatttataagtatctgatgtctgggttcttcactagactgtaaacttcatgatggcaggaaccataattgttctggttactcttgctctcaagagtgtaagagtgccacattgtgcctggcacatagcaggaactttatgatgattgttggttggaagacaggttgcctgacaggccagtcatctcaactactgtacttggatgtgtggttggaaataaaatggatccgtttaggagaggc

SEQ ID NO: 375189 - DNA, 382 bp, Homo sapiens
tttggattacttaggcaaggaggagctaatcaggccttaggaagaatgagaactggggacgctctagggcagtcagtagcaggaatttacagacagtttctctagactacagcactgctgtcaggaagttttggctcaggctgccttttatccttggatggctgctcaagattcaaagtcctgtgagagggggtctgtttggtctttattgccaaatagatcatttccttcatgggtgaatggtgtactaggtttgagcctgcttgagtgttggccacccctgtggtcagctggggagtaagctactgtatttcatgcctgcttagacctcacagaataagggaaaagaatttccctaattgaaaagtgaaatgtgttacag

SEQ ID NO: 375190 - DNA, 291 bp, Homo sapiens
tcccatgcagcatggtactggactgaatgctgtaggcagctggaacacgatggtaagtttctgtgtatctaaccatagctaaacatagaaaaggtacagcaaaaatatggtatagaagatttttgttaatggggtacctctatcgtgcacttattacaaacagaacttgtaggcctgaggttgggcatggtggctcacacctgtaatcccagcattttgggaggccaaggcaggcggatcacttgaggtcaggagttcgagaccagcctggtcaacatggtgaaactccat

SEQ ID NO: 375191 - DNA, 206 bp, Homo sapiens
tgatttttctgcatgcttccaatttaagaggtataaaatagtccttcgatgtggtttttattttgcctttctttgactgtgaatgaccttggccatttcctcatattttttggttattgtatttgcacttgcacaccttgtctctctagcttttgcctcttttttttttcctgttggtatctttattgatttattttatgagttct

SEQ ID NO: 375192 - DNA, 558 bp, Homo sapiens
tagagattcaactctaaagtggaacagagaaagcccactgctggacagctagtgttggccagcgttcattcattctcctctctctgcacagtggcaacacggagcgctctgaatccctgcatgacaacaccctcgtgctgatggtgccactgatgcacgaggtggacacgtccatcaccgggtgagtagcctggtcctgggttgccacaacacaggagtgccctccagtggaacactgtgcttctcatatttgcatgtgtagccagccaggagccaaggctgtgccacctccacttcctcccagccttgaaaagcaggatgaagctttagctgcagtaactcatacactcctccctccttgttttctcctctgtcccacctacccacccacctggtagataatctgagaagtttgatgacaagtttaagccccataatttctttgaacattccatatacctttatgtgcatatattctctctccactccttttacttcatattagaaggacgatatcctctgtgataccacagctctaccttctctctccactcccga

SEQ ID NO: 375193 - DNA, 4554 bp, Homo sapiens
  misc_feature (576)..(576): n is a, c, g, or t
ccgcgctcggcgccctgctcgccgggcagaggggaaggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctgggtccttgtgggcgcaccaaaggcagattccaaatacagcccttcagtgaagtctcctggggctgtgtttaagtgccgtgttcacaccaaccctgaccggagatgcaccgaactggacatggctcgagggaagaatcggggcacgtcctgcggaaagacctgccgggaagaccgcgatgatgagtggatgggggtgagcctggcccgacagcccaaggctgatggccgtgtgttggcctgtgctcatcgctggaagaacatctactatgaagccgaccacatcctaccccatggcttctgctacatcatcccctccaacctccaggccaaaggcaggacnctgatcccttgctatgaagagtataagaagaagtacggagaggaacacggctcctgccaggctgggatagcgggcttcttcactgaggagctggtggtgatgggtgctccagggtcattttattgggctggaaccatcaaagtgctgaaccttacggacaacacctatttaaaactgaacgacgaagtgatcatgaacaggcggtacacctacctgggctacgcagtgaccgctggccacttctctcacccgtccaccattgatgtggtaggaggtgccccacaggacaaaggcatcggcaaggtttatattttcagagctgaccgaagatcaggcaccttaattaagatctttcaagcatcaggtaaaaagatgggctcttacttcggctcctccttgtgcgcagttgacctgaatggggacggcctctctgacctgctggtgggggcccccatgttttctgagatcagggatgagggacaggtcactgtctacatcaacagaggaaatggagccctcgaggagcagctggctctgactggggatggtgcctacaatgcgcactttggagagagcattgccagcctggacgatctggacaatgatgggttcccagatgtggccattggtgcacccaaggaggatgacttcgcaggggcggtctatatctatcatggtgatgccggtgggatagtccctcagtactcaatgaaactgtctgggcagaagataaatccagtgctccggatgtttggtcagtccatatcgggaggcattgatatggatggaaatggctatcctgatgtcactgttggagccttcatgtccgacagcgtggttcttctcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccagaagagattggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcagactgtttttgaaaggaattgccgttcagaggactgtgccgcagacctgcagcttcagggtaaactgctgctctccagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggaggagatgggcatctcctgtgagctgctggaatcggacttcctcaaatgcagcgtgggatttcctttcatgaggtcaaagtcaaagtatgaattcagcgtgatctttgatacaagccacctgtctggggaagaggaagttctcagcttcattgttactgctcagagtggcaacacggagcgctctgaatccctgcatgacaacaccctcgtgctgatggtgccactgatgcacgaggtggacacgtccatcaccggaatcatgtctccaacctcctttgtatatggcgagtccgtggacgcagccaacttcattcagctggatgacctggagtgtcactttcagcccatcaatatcacccttcaggtctacaacactggcccaagcacccttccagggtcatctgtcagcatctctttccctaatcgactctcatctggtggtgcagagatgtttcatgtccaggaaatggtggtgggccaagagaagggaaactgctctttccagaaaaacccaactccctgcatcatccctcaagaacaagaaaatatcttccacacaatatttgcttttttcacaaagtctggaagaaaagtcttggactgtgaaaaaccaggaatttcttgcctaacagcacactgtaactttagtgctcttgctaaagaagaaagtcgtactatagacatttacatgctgctgaacacagaaatactgaaaaaggacagttcgtctgtcatccagttcatgtcccgcgccaaggtgaaggtggatcctgccctaagggtggtggaaatagctcatgggaacccagaagaggtgacggtggtcttcgaggccctgcacaatctggagccccgtggctacgtcgtggggtggatcatcgccatcagtttgttggtgggaatcctcatcttcctgctgctggccgtgctgctctggaagatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaagatgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttataattcactcaagcactgatatctggcctaaaatcttggaagtacatgtccatgaatacaaattttaaaggatgaaaatcttaccgtactttggaacttgctgtttaaaaagacagatgaaataagttgaagaaacctcatgtaatgaatccaccaggctggcagtggtgcatataaactgtgggtgtggcaagaccccgaagacatttcacatctttatcgcctcgatcaagtgtggagtcacatgctaatgtgtgctaaagaactgtaagtgttttttcatatgtacttttcattggaagattcccaacaagaatttggatggaaaacctgatccctagcaagaagtctgctctgtatcacctttatatagcagacatgtcaccctgcttctacacagatgatggatgaaagcttggagcaatgccatgtggtcatctggtaaacctcagaatggcgtctcatcctggacatcctgcatcagagttcacacaccacaaggactaaatccttgtcccctaagcaaagaattgggtctgaatgctggtgagggattgcctttttgtggtaattttcattgagagatcttcatttcccctaccaccctggctgtcccagctagtggtgattgcagattccttcccagagaggacatttaaccgttttaaaaaaaatgtcttagattgggttcccaagaagcagtccctgaaacaaggatttgtgtgcaagtaacttattaaggaagtattcccaggggataccagtaagagagtgggggaagcaggacaaggaaggagacaaagccaggcaaatgtttgtcatttcagggagagctccatgaagtttagcctcagcctgatcaggggtgggtggatagcggctctccagccacccctaactgagaccagtttaaccacacataactcggctcacttctcaacttttctgttcagcaggattaccctgataccaaagccagatgacgacatgaaaggaaactacagacaa

SEQ ID NO: 375194 - DNA, 2407 bp, Homo sapiens
  misc_feature (576)..(576): n is a, c, g, or t
ccgcgctcggcgccctgctcgccgggcagaggggaaggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctgggtccttgtgggcgcaccaaaggcagattccaaatacagcccttcagtgaagtctcctggggctgtgtttaagtgccgtgttcacaccaaccctgaccggagatgcaccgaactggacatggctcgagggaagaatcggggcacgtcctgcggaaagacctgccgggaagaccgcgatgatgagtggatgggggtgagcctggcccgacagcccaaggctgatggccgtgtgttggcctgtgctcatcgctggaagaacatctactatgaagccgaccacatcctaccccatggcttctgctacatcatcccctccaacctccaggccaaaggcaggacnctgatcccttgctatgaagagtataagaagaagtacggagaggaacacggctcctgccaggctgggatagcgggcttcttcactgaggagctggtggtgatgggtgctccagggtcattttattgggctggaaccatcaaagtgctgaaccttacggacaacacctatttaaaactgaacgacgaagtgatcatgaacaggcggtacacctacctgggctacgcagtgaccgctggccacttctctcacccgtccaccattgatgtggtaggaggtgccccacaggacaaaggcatcggcaaggtttatattttcagagctgaccgaagatcaggcaccttaattaagatctttcaagcatcaggtaaaaagatgggctcttacttcggctcctccttgtgcgcagttgacctgaatggggacggcctctctgacctgctggtgggggcccccatgttttctgagatcagggatgagggacaggtcactgtctacatcaacagaggaaatggagccctcgaggagcagctggctctgactggggatggtgcctacaatgcgcactttggagagagcattgccagcctggacgatctggacaatgatgggttcccagatgtggccattggtgcacccaaggaggatgacttcgcaggggcggtctatatctatcatggtgatgccggtgggatagtccctcagtactcaatgaaactgtctgggcagaagataaatccagtgctccggatgtttggtcagtccatatcgggaggcattgatatggatggaaatggctatcctgatgtcactgttggagccttcatgtccgacagcgtggttcttctcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccagaagagattggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcagactgtttttgaaaggaattgccgttcagaggactgtgccgcagacctgcagcttcagggtaaactgctgctctccagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggaggagatgggcatctcctgtgagctgctggaatcggacttcctcaaatgcagcgtgggatttcctttcatgaggtcaaagtcaaaggtaagggacacagacgggacccttcctcagcagcaggcccccagcccttccaccagccactgattccgccgcctccctgaggtgaggagtcctcccaccccctgcctcccatagcagctggggcggccactgaagccctgacatgctcctgtccctggctgtgtacaccggggtatactccggaggggctgcatcatatggt

SEQ ID NO: 375195 - DNA, 440 bp, Homo sapiens
gtgggccaagagaagggaaactgctctttccagaaaaacccaactccctgcatcatccctcaagaacaagaaaatatcttccacacaatatttgcttttttcacaaagtctggaagaaaagtcttggtaaggatttgtttagtggttggggtaacacgggtggtcctcactcggaagacaccagttttctatttgatatttattatttcctaaatctggttttaatcaatttgacttacaaaggcacagactgtggtcaactcctaattttcagtctgaggtttcaatcaaaatgttaaatttacattccaaatcctattacctggaaaagggataaatctttgcaacccaccaagcacaaagtaaaatgtttcttccactagaatgagtctaaacaagagtgattattcttgtgcaaacattttgggaaactgtttgat

SEQ ID NO: 375196 - DNA, 665 bp, Homo sapiens
cgtggatagaataggggcctggcctgtcgtgaattctgtcaccttgctcagtctcttcacatctttagtcctgataatcccgtctgtataatagattccataatgctgatgaatctggtgaaatctgtttttgttgcttagctggggaaaaaaaagttcttggtgtgaggaatttctcctttgttgtgactgtggttctcattgcattcccctcctcccctcctcacttccttctctgcttaccgttggatttctttttggtaggagctggtggtgatgggtgctccagggtcattttattgggctggaaccatcaaagtgctgaaccttacggacaacacctatttaaaactgaacgacgaagtgatcatgaacaggcggtacacctacctgggtgagtactcagggagaggaacaggtaagaaaggggaaatgggagtgattcccaccagattcacaaattattgcttcattgttggaaagaggagttagttggctttgacgcctgttgttctaatgacttacatctttagccagggcatcttcacatctagctccacaaacacaaggtagagaggaaaaccaaggagggaactgaattaaaactgtatgctttaattaaaaagctgacagttgaacctccagggaaataaacattttatttt

SEQ ID NO: 375197 - DNA, 2092 bp, Homo sapiens
aagcccgggaaggcaggcgcgcgggttagaacgcgccagaggtcggcgcgcgcacacccgcaccgccccgaccccaggtagtgaggccagtgattccgagtgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagggtccacgagctcaagattgaagaatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375198 - DNA, 809 bp, Homo sapiens
ggtagatcacttgaggtcaggagttcaagaccagcgatggtgaaaccccatctctagtaaaaatacaaaaagtagccgggtatggtggcgcacacctgtagtctcagctatttgggtggttgaggcaaaagaattgcttgaacccaggaggcggaggttgcagtgagccgagactgcaccactgcactccagcctgggcaacagagactccatctcaaaaaaaatattaagattcctaccaaatcagcctctggtgaacctctctaaggtgcatgttaagcaagcttcccaggcatcgagaacctacaatgcaagaggactgcctcccaagtcagtgccttgggaacccgtgttccttatggagaacggggtctccttagccccgctggatcctcccccatggggaaaagggactatgcctacaggcctgggcagaagaggctgagtgagtttggttcattcttccccttatgattaagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375199 - DNA, 2362 bp, Homo sapiens
aagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtaggccaacccttcctgcgacctggactgcaggagcaggggctgcttggctggaattgagcacagaggctggattacatctttcaagtttctcagcttgaactggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagggtccacgagctcaagattgaagaatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375200 - DNA, 1816 bp, Homo sapiens
aagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttagatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375201 - DNA, 2422 bp, Homo sapiens
aagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtatgggctagaaggtccctgtgctggggaactcaaggctttaagccctgcagtgagcatattgctcagagagtctcataaggtcttcctgggcctcgggttgtaaactgctgcactcagatgtgatgggactattcactggaggcctcggctggactatctcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagggtccacgagctcaagattgaagaatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375202 - DNA, 2237 bp, Homo sapiens
aagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtaggccaacccttcctgcgacctggactgcaggagcaggggctgcttggctggaattgagcacagaggctggattacatctttcaagtttctcagcttgaactggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagggtccacgagctcaagattgaagaatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375203 - DNA, 2131 bp, Homo sapiens
aagtgctgggattacaggcgtgagccaccatgcccggccaaagttattattttttttaatgtaaactctgcaggagccagaatcttgtctcaggttcactgttgtattccctgagcctacaatagagcttgatgtataaccgaaacacagccccagaatttgtggtggacgaatgaataaaaagacaccagtgtctggcacatataatgcaggttactaagtggtaatgtactaatactgtgtgtcagtcactctggtaagtgttagggatgcagatgtgaagataccatcccatccctccccttaagaaattcaatttaatagagaaaacagacacaaataagtgcagaaattgctaaaagaagtgtgtccagaatgcaatctggactccagggaaacagagttaagccaccagagtcggggaggctggagcaggcttcagagaactgactcggcttagcaggaggtacctgccagttacaggcagtggccctatgtggcagcagtgctgggaagaggcaggcaatgaggtgtgtagttgagagtggtgtgggaaagaatgggagtggtagtagcttgctgatggcttctccccttcttctgtagggaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagggtccacgagctcaagattgaagaatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375204 - DNA, 2296 bp, Homo sapiens
aagtgctgggattacaggcgtgagccaccatgcccggccaaagttattattttttttaatgtaaactctgcaggagccagaatcttgtctcaggttcactgttgtattccctgagcctacaatagagcttgatgtataaccgaaacacagccccagaatttgtggtggacgaatgaataaaaagacaccagtgtctggcacatataatgcaggttactaagtggtaatgtactaatactgtgtgtcagtcactctggtaagtgttagggatgcagatgtgaagataccatcccatccctccccttaagaaattcaatttaatagagaaaacagacacaaataagtgcagaaattgctaaaagaagtgtgtccagaatgcaatctggactccagggaaacagagttaagccaccagagtcggggaggctggagcaggcttcagagaactgactcggcttagcaggaggtacctgccagttacaggcagtggccctatgtggcagcagtgctgggaagaggcaggcaatgaggtgtgtagttgagagtggtgtgggaaagaatgggagtggtagtagcttgctgatggcttctccccttcttctgtagggaatttttcacagacaacctatgggacacactcccttgctcatggcaggaagcattggatggactgaaaccaccacagctggccacaatgctgctggggatgcctggggaaggggaggtcgtcaggtatgggctagaaggtccctgtgctggggaactcaaggctttaagccctgcagtgagcatattgctcagagagtctcataaggtcttcctgggcctcgggttgtaaactgctgcactcagatgtgatgggactattcactggaggcctcggctggactatctcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagggtccacgagctcaagattgaagaatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375205 - DNA, 2762 bp, Homo sapiens
  misc_feature (2762)..(2762): n is a, c, g, or t
aagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagggtccacgagctcaagattgaagaatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttcccaaaaaaaaaaaaaacaaaacaaaacaaaacaagaaaaacacaaagcaaaaaaaacaaacccccctctttcgccccccaacaaccaccaccactcacccacaacccccccaccccagcaccccgccccgacgaggagcgcagaaaccgcgccgcgcgcccccagtacgcggcagaccatccgctcacagaccaggcgcagcagcccccactaaacaagcggcagaggccagagcgccgcaccggagaacaccggaaccgaacgacagaacagcacgcgagcgcggagagcaagtgcgaccgcaaccgagagcacgcagccgcgagccaaaccgagccgaaagagcagcggccgagacacacaaacagccagcaaaagacgagctacacgagcaccacccgccgacaacgcagaccacacgcgccccacgcagagcacgggccactcagcacccaccacgagcccagaccgcacaaccacaccacacgcaacaccccgccaacgacan

SEQ ID NO: 375206 - DNA, 885 bp, Homo sapiens
tctctactaaaaacacaaaaaattagccaggcgtggtggcgggcgcctgtagtcccagctactcgggaggctgaggcaggagaatggcgtgaacctgggagacggagcttgcagtgagccgagatcgcaccactgcactccagcctgggcgacagagcgagactccatctcaaaaaaaaaaaaaaaaaaaaaaaaaaaaaaaaaaaaaaaaaatatatatatatatatatatatgcacatatgttcatgaaaacgcatattggggtagaaaataaagcaaagttggaactgaattaggaacaagcaaagtttaagtgagaggtgacagttcttaaaaccaaactgagtgctgaatgtgactgatcccacagatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375207 - DNA, 2257 bp, Homo sapiens
aagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagggtccacgagctcaagattgaagaatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375208 - DNA, 1287 bp, Homo sapiens
  misc_feature (2)..(2): n is a, c, g, or t
  misc_feature (8)..(8): n is a, c, g, or t
  misc_feature (31)..(31): n is a, c, g, or t
  misc_feature (37)..(37): n is a, c, g, or t
  misc_feature (89)..(89): n is a, c, g, or t
cnagctgnaaacctcacccgtgtcagggcanggcgcntctgctgctcacaggcctccacgcctgtgggcgatctgagtgttgccttgcngagacacttctcctgctgtcctgaggtggtggccctggctcagtgggctgctgctacatgaagctgagtgaccctggcggctacccactgagtcagtgggtggctgggctgcctggctatgaactgccctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcagatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375209 - DNA, 2194 bp, Homo sapiens
aagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagggtccacgagctcaagattgaagaatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375210 - DNA, 1772 bp, Homo sapiens
aagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcagatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375211 - DNA, 1772 bp, Homo sapiens
  misc_feature (2)..(2): n is a, c, g, or t
  misc_feature (8)..(8): n is a, c, g, or t
  misc_feature (31)..(31): n is a, c, g, or t
  misc_feature (37)..(37): n is a, c, g, or t
  misc_feature (89)..(89): n is a, c, g, or t
cnagctgnaaacctcacccgtgtcagggcanggcgcntctgctgctcacaggcctccacgcctgtgggcgatctgagtgttgccttgcngagacacttctcctgctgtcctgaggtggtggccctggctcagtgggctgctgctacatgaagctgagtgaccctggcggctacccactgagtcagtgggtggctgggctgcctggctatgaactgccctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagggtccacgagctcaagattgaagaatatgtgcagcgggggctacagcgagtggggctagatccccagctgccactgaatctggctgcccttcaggcccacctggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375212 - DNA, 2039 bp, Homo sapiens
aagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375213 - DNA, 1612 bp, Homo sapiens
aagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttagatatgtgcagcgggggctacagcgagtggggctagatccccagctgccactgaatctggctgcccttcaggctctttctgttctggagactgaagacagctgatgcagcctgaggagacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttccca

SEQ ID NO: 375214 - DNA, 1322 bp, Homo sapiens
gctgcattacagacacagacctgcaaacatctatggttgtgacagagtttctttctgacacctgagtctttctcctgctgcacggaaagcttgctgggaggggcttggaatctggcatgaagccaaagggcatctctgagttgcagcatttaaatgatcccactcagagattcacacagaagactggacacaattccgaagagctgcccagaaggagagaacaatgtcatcactacccagtggcagacacctttcaccccagctacacaagagggggcagatgtgtgaggatcactgcagtccaggagttcgatgtttcagtgagctgtgattgcaccactgcatatcagcctgggtgacagagcaagaccctatctcaaaaatacagaaaaatcatcaaccacttgcagtcgtcgtagaaatcaatcattccctccagttatgtccctgacccacaggcttcatttgtgcaagtactggggctgtgctgtcagtaatgtgtgccgcttctgggaaggacgtccattgcccttgatgattgtggtaccatacacactgcctgtttccttgcctgttggttcgtgcgtgataatcacagggacaccgatcctcacttttgtcaaggacccacagctggaggtgaatttctacactgggatggatgaggactcagatattgctttccaattccgactgcactttggtcatcctgcaatcatgaacagttgtgtgtttggcatatggagatatgaggagaaatgctactatttaccctttgaagatggcaaaccatttgagctgtgcatctatgtgcgtcacaaggaatacaaggtaatggtaaatggccaacgcatttacaactttgcccatcgattcccgccagcatctgtgaagatgctgcaagtcttcagagatatctccctgaccagagtgcttatcagcgattgagggagatgatcagactcctcattgttgaggaatccctctttctacctgaccatgggattcccagagcctactaacagaataatccctcctcaccccttcccctacacttgatcattaaaacagcaccaaacacaagaacacaaaaacaaaaaaaaaacatgggggggcgaggggccctcggaaaaggtttaaaaaaccaatctcgatgaggggcacaggagcccacagagaggcaacggacgacagtgccaaaagggggatcccagaggagaacacggggacgagaacaaaggaggaggaattttcaacaactaaaaaaagccccggcgggaaaacgagacgttacaggaacaacccgaagggggctccgagag

SEQ ID NO: 375215 - DNA, 310 bp, Homo sapiens
gagtgtgtgtctgcacaatggggggacctgcccaacatgctgtgtgctttgacctcagcaaggacccacagctggaggtgaatttctacactgggatggatgaggactcagatattgctttccaattccgactgcactttggtcatcctgcaatcatgaacagttgtgtgtttggcatatggagatatgaggagaaatgctactatttaccctttgaagatggcaaaccatttgagctgtgcatctatgtgcgtcacaaggaatacaaggtgagtacttcaggatcttccagcgctggagctctgtgggc

SEQ ID NO: 375216 - DNA, 1017 bp, Homo sapiens
gctgcattacagacacagacctgcaaacatctatggttgtgacagagtttctttctgacacctgagtctttctcctgctgcacggaaagcttgctgggaggggcttggaatctggcatgaagccaaagggcatctctgagttgcagcatttaaatgatcccactcagagattcacacagaagactggacacaattccgaagagctgcccagaaggagagaacaatgtcatcactacccgtaccatacacactgcctgtttccttgcctgttggttcgtgcgtgataatcacagggacaccgatcctcacttttgtcaaggacccacagctggaggtgaatttctacactgggatggatgaggactcagatattgctttccaattccgactgcactttggtcatcctgcaatcatgaacagttgtgtgtttggcatatggagatatgaggagaaatgctactatttaccctttgaagatggcaaaccatttgagctgtgcatctatgtgcgtcacaaggaatacaaggtaatggtaaatggccaacgcatttacaactttgcccatcgattcccgccagcatctgtgaagatgctgcaagtcttcagagatatctccctgaccagagtgcttatcagcgattgagggagatgatcagactcctcattgttgaggaatccctctttctacctgaccatgggattcccagagcctactaacagaataatccctcctcaccccttcccctacacttgatcattaaaacagcaccaaacacaagaacacaaaaacaaaaaaaaaacatgggggggcgaggggccctcggaaaaggtttaaaaaaccaatctcgatgaggggcacaggagcccacagagaggcaacggacgacagtgccaaaagggggatcccagaggagaacacggggacgagaacaaaggaggaggaattttcaacaactaaaaaaagccccggcgggaaaacgagacgttacaggaacaacccgaagggggctccgagag

SEQ ID NO: 375217 - DNA, 2272 bp, Homo sapiens
tcaagtagctaatcaatctgattcatcctctccctgcaattctagtcttattcaataattccttctgcttaggtaggtcctcattcacccatgtacttatcaagcacccaccatgtgacagatgccaagtgaggtgaaagtgctgggatgagcacctctgtggatctcacaatgaccatccatcttttgcatccttcttggtttttcctttacccaagtcctgcacttcactctttacccgtgcttcagaaaagcggaagttggttaattaattccatttgtctaacacggatgagagtgacagcagacaaggggaaaggcagggaaattcccttagactgttcttacatgcactctcacacttaatagtcaaagccaccctatgaaatagacactacgttattagcctgagttacataaacgagtaaacagaggcttggagaagttaaaaataaattgccctcagtcctaactggagagtggtggagtcagaatttgaatccaggtttaaagaattctagtgccggcactctgcacctatttctctttggacactcatttcccctaaggatcagagaagctcaaagtaggccacttttcgtctccgtaagtccgcaaggtcctgcgagatcacagtgagcagggcaccagcaaatacagtctgcgaccgcgagacgtaaagggaagaacgctcctcggcacccctccccagtctatcctaaagtcaagaacgtccgagcccgcctttctccgggggcgggctgcaataaaacagcaaaatcctccattccccatcagcggtcgattgggggctctttcgaagcggcagctctgtaggaccgctcttctaccccaagatccctcggcttcggccccctaggtgccagggtctgcgggaccccacgctcaaagccgccggccggggtcgacaactgcagagagggtcgggataggaaattgcgggtagcggcagatgcgggtccccaggcatcccggaggttcccacaggtctgcagtgggcctactttgcgaaaagggcccggctgcgccgagcctcgttcaaatcagatgccagacagtgtttcttgggatccatccaaataggtcccttatttctctttgtgggagccctgggcctccttccaggccggaacccaagtgcttaggcagccgggaaaggccggtcccctttttcagttctctcgcgacctctagccacttccggttgctaacggttcccaaacagcccccgaaaacgctacgtgagctgggccctgggccagaggcagaaaacggacggaagaaaaggtctggccggagatgggtctcactctgtcacccagactggagtgcagtgagtggtgcgatcatagcttactgcagcctgaaactcctgggctcaagtgatcttctcgcctcagcctcctgagtagctggagctacaggtgtgagctacccagcatggctcatttgagatttctgagtagagaagtaacatgattaaacttgggtattgagattattattttggctgctatgttaacagtagacttgaatgtgaaggggttgggcaagggcagaagcagggagacaggttggaaagttggagtgggaagggcctttttaagaataacacaaacccctaaagacataaaactgaaaaggccatggaggaaaagataaatgaaactggccttgtaaaattgaaatatttgaatgaaaaaagtaaaaataaaatataaactaaaagtaaaatatgccacacatctaaaagacacagctgattttcctgatatacaaagaccttttatcttaccaaaaaataaaaatatgaacaagccaatagaaaaatagacaaagtacttaacctgcatgcatttattgtcaggcctctgacaatatgatactaagccatcatagcccctgtgaccgccacgtatacatccagatgacctggagcaactgaagaaccacaaaagatggcattccaccattgagatttgttcctgccccaccccaactaatcaatcgaccttgtgacattccccctgcccccgacagtgagtctcatgatctccccacccagcaccttggcaccttgtgacccccgcccctgcccacaagagataaccacctttaactgtaattttccactacctacccaaatcctataaaactgccccacccctatctccctttgctgactctctttttggactcagcccacttgcacccaagtgaaataaacagccttgttgctcacacaaagcct

SEQ ID NO: 375218 - DNA, 2370 bp, Homo sapiens
tttttttttcaggtcaatgatgtagcttctattaaaagggaacagaaaagagggtacaaaatggatttaggtgatccaggggattcagaaaaggtaattttaagacaaaaaagtaaattctactttacagagaaagcactaagtgtgtagtagaggttgggctatgaaattatatattatgaaaatattacaaaaaagtaaaggtatttttttaatgacagtggcctagaatagctttttaaaggaaattacggaagctggtgtacaacttcctgctgaggctgatatgagggaggacagcattacgccattctgcatcaggtcttgttggtgccacataagctggaatgtagtacttcaggagatggaccttccatctgattcagcatggtggattatgtctgagatgctcctgatgctgttcagcctgggtagctggcagagctttcaaccactccctttctctcgagatggactgtgatgctcaccttgctcatgaatggcctggaattctggatattcccatttaagctgtcttttcattggctggaaaggaatagttggtggctcctgtgctgcttgatgatgatattctgagtgcagtcccattccatatgcactggctgcaacttgggaacaattagatatggctgggcttgtgaaagactcaatgatggaaccacagttactatctttaaaagacatcttagagaacacatctcagggcatagaatagagaaagaatgctgacacagtcttcttccacccttaagaagtaaggagctaaccagaaaggatgagagtacgaaacatagagacttacatatcaagcgggagggagtggagattgagctctgcaaccttgcttccctggatgtatggctgcttctttctctggctagggtgttcatgtgccttttaatcacacccgatattctgtttcatcaagctctctttccaaatcctccgatatgatcaccatttcctctctgttctccggctgatgctctaacatccgggcttggagctcctctggcaggatagtcaagaactgctccagcaccagcaattccaggatctgttcttttggtgtgggtctctggcctcagccactgatggcaaagttcccagaatcagctcacagccttacagggtccaggtgtctcctggtagcagaaatgcctaacgttctgatgagctacctcccggttgctggagttcttccatatgaagtagcccatattcttggccccaagtgtagtcctctgctttaactgtcaggcgacttttttattccctttgagatttaatagtcaaggctgcagctgttatgggctgtaacatttcacgtaaagtcttcttttgcaggttggggtatatggaagtctgctttaaggaggctgtccttgagcaagtttcttttgggtcactcctcatttctcccacagggctcctctgctaatgcttctgggagacaccttcatacggccagcgccaggaggcgagaggagaggaaaggaagtcttctcttcacgccctcctggggcccgtcttggcgttgtgtgtggtggagggggacgaatctggggtccgcagtcgcagcctcctcttgctgctgccgccttcatccccgaaatcctgctcctaaccatcaataggaaccctgaaaaaagtcagaggtgtgaagtgcacacataaccctgggccacaaactcggtcccggacgccacaggacaatcgctcaccaggaccacacatcctggccggaagatgggcgggtaccgcggctcccgatgcttccggctcctctaggaagaggctctgggtggtggcctcacgcgccccctccggggagggagccgccgcggggtttgagggcgcagtaggctcccgtcctagcgggtcgcagctccttacaagattttgaaatgttggtggattaatcttctagaagggtgctaggtctccccgtttcccccgccaccaactttagagttgtggtgtacaagcgctatcttttctgatgttatatcccataggaatattttcagtgacataatcaagtttaagcattaagaactagggccctggaataaaatgtgcgttaaaatcctggttctaccacttactatgtgatctttagcaagatagttaacttcactacagctcaattttctcatctataaaatgtgaaaaataatagttacaaaatgagataggacatactagcacactacctgtaaaaaactgtgggctcaacattaccttaaaaaacaatccaaatattgtgttacttagatcccgtcaggacatttttaaagtcattgaaaataaatgctaagctatttcttataaagcctcttagtggga

SEQ ID NO: 375219 - DNA, 2255 bp, Homo sapiens
tcaagtagctaatcaatctgattcatcctctccctgcaattctagtcttattcaataattccttctgcttaggtaggtcctcattcacccatgtacttatcaagcacccaccatgtgacagatgccaagtgaggtgaaagtgctgggatgagcacctctgtggatctcacaatgaccatccatcttttgcatccttcttggtttttcctttacccaagtcctgcacttcactctttacccgtgcttcagaaaagcggaagttggttaattaattccatttgtctaacacggatgagagtgacagcagacaaggggaaaggcagggaaattcccttagactgttcttacatgcactctcacacttaatagtcaaagccaccctatgaaatagacactacgttattagcctgagttacataaacgagtaaacagaggcttggagaagttaaaaataaattgccctcagtcctaactggagagtggtggagtcagaatttgaatccaggtttaaagaattctagtgccggcactctgcacctatttctctttggacactcatttcccctaaggatcagagaagctcaaagtaggccacttttcgtctccgtaagtccgcaaggtcctgcgagatcacagtgagcagggcaccagcaaatacagtctgcgaccgcgagacgtaaagggaagaacgctcctcggcacccctccccagtctatcctaaagtcaagaacgtccgagcccgcctttctccgggggcgggctgcaataaaacagcaaaatcctccattccccatcagcggtcgattgggggctctttcgaagcggcagctctgtaggaccgctcttctaccccaagatccctcggcttcggccccctaggtgccagggtctgcgggaccccacgctcaaagccgccggccggggtcgacaactgcagagagggtcgggataggaaattgcgggtagcggcagatgcgggtccccaggcatcccggaggttcccacaggtctgcagtgggcctactttgcgaaaagggcccggctgcgccgagcctcgttcaaatcagatgccagacagtgtttcttgggatccatccaaataggtcccttatttctctttgtgggagccctgggcctccttccaggccggaacccaagtgcttaggcagccgggaaaggccggtcccctttttcagttctctcgcgacctctagccacttccggttgctaacggttcccaaacagcccccgaaaacgctacgtgagctgggccctgggccagaggcagaaaacggacggaagaaaaggtctggccgctcatttctcccacagggctcctctgctaatgcttctgggagacaccttcatacggccagcgccaggaggcgagaggagaggaaaggaagtcttctcttcacgccctcctggggcccgtcttggcgttgtgtgtggtggagggggacgaatctggggtccgcagtcgcagcctcctcttgctgctgccgccttcatccccgaaatcctgctcctaaccatcaataggaaccctgaaaaaagtcagaggtgtgaagtgcacacataaccctgggccacaaactcggtcccggacgccacaggacaatcgctcaccaggaccacacatcctggccggaagatgggcgggtaccgcggctcccgatgcttccggctcctctaggaagaggctctgggtggtggcctcacgcgccccctccggggagggagccgccgcggggtttgagggcgcagtaggctcccgtcctagcgggtcgcagctccttacaagattttgaaatgttggtggattaatcttctagaagggtgctaggtctccccgtttcccccgccaccaactttagagttgtggtgtacaagcgctatcttttctgatgttatatcccataggaatattttcagtgacataatcaagtttaagcattaagaactagggccctggaataaaatgtgcgttaaaatcctggttctaccacttactatgtgatctttagcaagatagttaacttcactacagctcaattttctcatctataaaatgtgaaaaataatagttacaaaatgagataggacatactagcacactacctgtaaaaaactgtgggctcaacattaccttaaaaaacaatccaaatattgtgttacttagatcccgtcaggacatttttaaagtcattgaaaataaatgctaagctatttcttataaagcctcttagtggga

SEQ ID NO: 375220 - DNA, 746 bp, Homo sapiens
ctcacagccttacagggtccaggtgtctcctggtagcagaaatgcctaacgttctgatgagctacctcccggttgctggagttcttccatatgaagtagcccatattcttggccccaagtgtagtcctctgctttaactgtcaggcgacttttttattccctttgagatttaatagtcaaggctgcagctgttatgggctgtaacatttcacgtaaagtcttcttttgcaggttggggtatatggaagtctgctttaaggaggctgtccttgagcaagtttcttttgggtcactcctaaggcaaaataaatcattactaactcgcagaaatgaaaaggttgctaagaacttttttttttaagattaaagacgtctagttatcttgaaattcattgattcaaaccaccaattcaaaaggaaaatgaacaattcgggtgaattttatcatgtgcgacagaaagcacaaactaggtaagacagacatacaatttataatatgatttgaaaatttcagatacgaggatgaaatcacttttgtcagacccagataaaatacggcggggatggcatgaaggagaggaggttcatgcttacatgtttgagataagaactgtttccaaggactttctaaacaccgcataagaaaccatttcatttcctccatgcatctcctgctttgacaaggtttatcagtagacattctttatagcactgctgtaattcagacacgatgttctggaaagaac

SEQ ID NO: 375221 - DNA, 2058 bp, Homo sapiens
tcaagtagctaatcaatctgattcatcctctccctgcaattctagtcttattcaataattccttctgcttaggtaggtcctcattcacccatgtacttatcaagcacccaccatgtgacagatgccaagtgaggtgaaagtgctgggatgagcacctctgtggatctcacaatgaccatccatcttttgcatccttcttggtttttcctttacccaagtcctgcacttcactctttacccgtgcttcagaaaagcggaagttggttaattaattccatttgtctaacacggatgagagtgacagcagacaaggggaaaggcagggaaattcccttagactgttcttacatgcactctcacacttaatagtcaaagccaccctatgaaatagacactacgttattagcctgagttacataaacgagtaaacagaggcttggagaagttaaaaataaattgccctcagtcctaactggagagtggtggagtcagaatttgaatccaggtttaaagaattctagtgccggcactctgcacctatttctctttggacactcatttcccctaaggatcagagaagctcaaagtaggccacttttcgtctccgtaagtccgcaaggtcctgcgagatcacagtgagcagggcaccagcaaatacagtctgcgaccgcgagacgtaaagggaagaacgctcctcggcacccctccccagtctatcctaaagtcaagaacgtccgagcccgcctttctccgggggcgggctgcaataaaacagcaaaatcctccattccccatcagcggtcgattgggggctctttcgaagcggcagctctgtaggaccgctcttctaccccaagatccctcggcttcggccccctaggtgccagggtctgcgggaccccacgctcaaagccgccggccggggtcgacaactgcagagagggtcgggataggaaattgcgggtagcggcagatgcgggtccccaggcatcccggaggttcccacaggtctgcagtgggcctactttgcgaaaagggcccggctgcgccgagcctcgttcaaatcagatgccagacagtgtttcttgggatccatccaaataggtcccttatttctctttgtgggagccctgggcctccttccaggccggaacccaagtgcttaggcagccgggaaaggccggtcccctttttcagttctctcgcgacctctagccacttccggttgctaacggttcccaaacagcccccgaaaacgctacgtgagctgggccctgggccagaggcagaaaacggacggaagaaaaggtctggccggagatgggtctcactctgtcacccagactggagtgcagtgagtggtgcgatcatagcttactgcagcctgaaactcctgggctcaagtgatcttctcgcctcagcctcctgagtagctggagctacaggaatgagcatagatgaacaatgttgcatcacgcttgacatcaccggggcttctttccagtgtggatttgctcatgtaaaatgaggtgtgagctctgcctgaaagcttttccatatgcatcacatttgcagggcttttctccagtgtgggttctttggtgtctcaaaagatgtgagctgttactgaaagctttcccacacacatcacactcatagggcttctctctaccgtggattcgctggtgtccaacaagagctgaactgtatctgaaggcctttccacgcttgtcacattcatatagtttctttccactgtggattttctggtgacagaagaggcccaagcactagctaaagcttttccctcactcactacactgctatggcttctcttcagtatgaactctgatgttgtctcagatatgaactcagagaggatttcccacaatcattacactggtatggtttcttttccgtgtgagttctctggtgtcaaataacatctgagctgtgatgaaagactttcccacactcactacattggaaaggtttctcctgtgtgggtccttcaatgctgaataagatatgaactgtaataaaagactttttcacact

SEQ ID NO: 375222 - DNA, 2469 bp, Homo sapiens
tcaagtagctaatcaatctgattcatcctctccctgcaattctagtcttattcaataattccttctgcttaggtaggtcctcattcacccatgtacttatcaagcacccaccatgtgacagatgccaagtgaggtgaaagtgctgggatgagcacctctgtggatctcacaatgaccatccatcttttgcatccttcttggtttttcctttacccaagtcctgcacttcactctttacccgtgcttcagaaaagcggaagttggttaattaattccatttgtctaacacggatgagagtgacagcagacaaggggaaaggcagggaaattcccttagactgttcttacatgcactctcacacttaatagtcaaagccaccctatgaaatagacactacgttattagcctgagttacataaacgagtaaacagaggcttggagaagttaaaaataaattgccctcagtcctaactggagagtggtggagtcagaatttgaatccaggtttaaagaattctagtgccggcactctgcacctatttctctttggacactcatttcccctaaggatcagagaagctcaaagtaggccacttttcgtctccgtaagtccgcaaggtcctgcgagatcacagtgagcagggcaccagcaaatacagtctgcgaccgcgagacgtaaagggaagaacgctcctcggcacccctccccagtctatcctaaagtcaagaacgtccgagcccgcctttctccgggggcgggctgcaataaaacagcaaaatcctccattccccatcagcggtcgattgggggctctttcgaagcggcagctctgtaggaccgctcttctaccccaagatccctcggcttcggccccctaggtgccagggtctgcgggaccccacgctcaaagccgccggccggggtcgacaactgcagagagggtcgggataggaaattgcgggtagcggcagatgcgggtccccaggcatcccggaggttcccacaggtctgcagtgggcctactttgcgaaaagggcccggctgcgccgagcctcgttcaaatcagatgccagacagtgtttcttgggatccatccaaataggtcccttatttctctttgtgggagccctgggcctccttccaggccggaacccaagtgcttaggcagccgggaaaggccggtcccctttttcagttctctcgcgacctctagccacttccggttgctaacggttcccaaacagcccccgaaaacgctacgtgagctgggccctgggccagaggcagaaaacggacggaagaaaaggtctggccggttcatcaagctctctctccagatcctccagtaccgtcactgcctcctctccagtctctggatggtgtgcacgcacccatgcttgcaggtctttaggaagaatgctcaggaactgttctagcaccagcaggtctaaaatctgctccttggtgtggcattctggcctcagccactgacggcagagctcccacagctgggagatgggtctcactctgtcacccagactggagtgcagtgagtggtgcgatcatagcttactgcagcctgaaactcctgggctcaagtgatcttctcgcctcagcctcctgagtagctggagctacaggtgtgagctacccagcatggctcatttgagatttctgagtagagaagtaacatgattaaacttgggtattgagattattattttggctgctatgttaacagtagacttgaatgtgaaggggttgggcaagggcagaagcagggagacaggttggaaagttggagtgggaagggcctttttaagaataacacaaacccctaaagacataaaactgaaaaggccatggaggaaaagataaatgaaactggccttgtaaaattgaaatatttgaatgaaaaaagtaaaaataaaatataaactaaaagtaaaatatgccacacatctaaaagacacagctgattttcctgatatacaaagaccttttatcttaccaaaaaataaaaatatgaacaagccaatagaaaaatagacaaagtacttaacctgcatgcatttattgtcaggcctctgacaatatgatactaagccatcatagcccctgtgaccgccacgtatacatccagatgacctggagcaactgaagaaccacaaaagatggcattccaccattgagatttgttcctgccccaccccaactaatcaatcgaccttgtgacattccccctgcccccgacagtgagtctcatgatctccccacccagcaccttggcaccttgtgacccccgcccctgcccacaagagataaccacctttaactgtaattttccactacctacccaaatcctataaaactgccccacccctatctccctttgctgactctctttttggactcagcccacttgcacccaagtgaaataaacagccttgttgctcacacaaagcct

SEQ ID NO: 375223 - DNA, 283 bp, Homo sapiens
tgttggtgaaattccagcctcccttcatttccttttgttctttttctttctttaaccattttcaaaaacacagacctttttacatttttgttgtaaaacaatgaaacaaccaataagtgtacaatatagaaagtaaaaacatgttgtttcaaatgttaaaattgacttatgaagcatatatacacaaaagaatataagtgcatatatatgtatgtaggtatatatatacatgtgtgtatgtatattatgaagtagtataataaaactaaacataccctgcaac

SEQ ID NO: 375224 - DNA, 808 bp, Homo sapiens
  misc_feature (18)..(18): n is a, c, g, or t
  misc_feature (26)..(26): n is a, c, g, or t
ttgggttttactaagttnataggcangtgattggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375225 - DNA, 4139 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375226 - DNA, 415 bp, Homo sapiens
  misc_feature (104)..(104): n is a, c, g, or t
gagttgggggctggggggaatccttgccagttggtgaagccctgtggcaggaaggtatatgtggacataggagtatacctgaatctctttcttcagccactganctgcttgggttgggctgtgaatgataatggaatggctggagtctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375227 - DNA, 376 bp, Homo sapiens
tggcaacctggagagctcccgggccagagccaggaggcagctgtgcgatctggatgtacctaaaccctccagggccacatagtgaccccaggccctggtcactccatgcttgtggagggtgcttttgtcaaagaggcctcctttccctcacccagagctggatttccaagaggctcccatacctagctgccctggcagactcccagggaggaaaaacagcgtggccttggcagctgccccgaggaaggagcccacaggtgacagggagaagccattgccattccctgtcctggcccccttcagcaaccctggaggcctaattgaaccctgaggagctctactgagatttcagcatctgggtgtcctattctgaccc

SEQ ID NO: 375228 - DNA, 4398 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccacgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375229 - DNA, 4491 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctgcccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375230 - DNA, 4637 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagatgaagctgctgagacttgcagaggttaattactagcccttgatggccaagtggggattggaagtcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375231 - DNA, 3939 bp, Homo sapiens
aaatattatagtcgagctgggtttattcaggacgagggtgaccccaggccctggtcactccatgcttgtggagggtgcttttgtcaaagaggcctcctttccctcacccagagctggatttccaagaggctcccatacctagctgccctggcagactcccagggaggaaaaacagcgtggccttggcagctgccccgaggaaggagcccacaggtgacagggagaagccattgccattccctgtcctggcccccttcagcaaccctgaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375232 - DNA, 4545 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacgcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375233 - DNA, 3036 bp, Homo sapiens
ataaggccaacaccttctggccacgctccttctggaccacgctccttctggccacgctccttctggccacgctccttctggccacgctccttctggccacgctccttctggccacgctccttctggccacgctgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375234 - DNA, 4175 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctcctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375235 - DNA, 1852 bp, Homo sapiens
acatagaaaccgacctggattactgcgtgtctgacctccgatgacgtaggattttaatcgttgcagacaaaacgcaagcttctcacatagcggctgcgccatcgggatgtcctgatccaacatcgaagtctgtggtcctatcgtggggttggactctgaagagtacggatgtgctgccgttatgcctcgggtaacacgaacgtgacgcacgtatcagatcgccccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375236 - DNA, 1762 bp, Homo sapiens
cctctgtaaaactctctgagagttgatgcagagttaatcagacccatggatataagttaaaggtccgtaactgggcctccttgtttgataccctgtgagaggatggatcttggctgacagaacggatcagagggacccctcctgacatggtggggctgctgtggggaacctggtgacagtattttttgtggtttctgtagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375237 - DNA, 1403 bp, Homo sapiens
tgaaatcgtgtcctcgtgtcctgaacattcgtgccctgtgtcctgaacattcgtgtccttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375238 - DNA, 3481 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagtaagatggccccagtgtgtgtttcctgtttcccaaagcaagctttgagagccacctacctatgaccaatgctctctactccctgcagagatggcacagactgcaaataggcatgcttttgaagaaaatatacaattgatctttgaacaacgaagggcgtggggtgcccagctgcacacagttgaaaatccgtgtataacttttgactctccaaaagcctactgttaaccagaagccttaccaataacatatagtcaattagcacatgttttgcatattatatgtattacatactgtattcttacaataagctaaataaaaaatattactaagaaaatcacaaagaagggaacaacaaacactggggcctacttggtggggagagggaggagagtgaggtacagtttacctacttaacaaacctgtacacatacctctgaacctaaaataaaagttaaaatcataagagaaaata

SEQ ID NO: 375239 - DNA, 3060 bp, Homo sapiens
  misc_feature (3016)..(3017): n is a, c, g, or t
  misc_feature (3038)..(3038): n is a, c, g, or t
  misc_feature (3047)..(3047): n is a, c, g, or t
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagaggtccagnnccttcagaaaggggccggctncaagtttgnaagttattggttg

SEQ ID NO: 375240 - DNA, 1856 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggtatgtcttcctccctgg

SEQ ID NO: 375241 - DNA, 1105 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagataccctttagggctggtttgccttagttgaggaagaagaccctcctagggactctgtctgccatccaccctgctacagtctgggcctcggagacctgtggacagataagctgctgggcccagtcatcagtaactgtttactcagaaaaacaagggaagtgctctaagattacactaagaaggcttttgacccattcctcgccagtag

SEQ ID NO: 375242 - DNA, 321 bp, Homo sapiens
ggtgacagtattttttgtggtttctgtagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatggtaagaagtgtggggggcaggagatgagcctctgggcccgttatttagacccagagtataagagttgggggatacggggataggtgactcttttctctgacttcagagcaaaaaaaagacatgacattatagcaagaaag

SEQ ID NO: 375243 - DNA, 3947 bp, Homo sapiens
caaaattgatgtcatgagtccgtgccggtgttattagtgacatgggtgaccccaggccctggtcactccatgcttgtggagggtgcttttgtcaaagaggcctcctttccctcacccagagctggatttccaagaggctcccatacctagctgccctggcagactcccagggaggaaaaacagcgtggccttggcagctgccccgaggaaggagcccacaggtgacagggagaagccattgccattccctgtcctggcccccttcagcaaccctgaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375244 - DNA, 4569 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375245 - DNA, 4368 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagcccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375246 - DNA, 4503 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375247 - DNA, 3723 bp, Homo sapiens
agtcatcgctgctgcggcgctgccggccgtgctgggagagcaggcgagcagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375248 - DNA, 4515 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375249 - DNA, 3918 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375250 - DNA, 1604 bp, Homo sapiens
agacgccattcttgcatacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375251 - DNA, 1127 bp, Homo sapiens
tgaggagtctcgctctgttgccaggctggagtgcagtggcacaatctcagctcactgcaacctccgcctcccggtttcaagtgtctcctgcctcagcctcccaagtagctgggactacaggtgcgcgctgccacgcccggctaatttttgtatttttagtagagacggggtttcaccatgttggccaggatggtctcgatctcttgacctcatgatccacccaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggagaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaa

SEQ ID NO: 375252 - DNA, 3394 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagagatggcacagactgcaaataggcatgcttttgaagaaaatatacaattgatctttgaacaacgaagggcgtggggtgcccagctgcacacagttgaaaatccgtgtataacttttgactctccaaaagcctactgttaaccagaagccttaccaataacatatagtcaattagcacatgttttgcatattatatgtattacatactgtattcttacaataagctaaataaaaaatattactaagaaaatcacaaagaagggaacaacaaacactggggcctacttggtggggagagggaggagagtgaggtacagtttacctacttaacaaacctgtacacatacctctgaacctaaaataaaagttaaaatcataagagaaaata

SEQ ID NO: 375253 - DNA, 2862 bp, Homo sapiens
cgcgtcgtgaggcgcgcgcccgcccgccgcctgccgcggatcgcgtggtctgcttggctcgccgcgcctctcccccgtccgtccatattgctgcagcccccgagccgggaagcccgggccgccccgggggcgggggggagggagggacgggactagaagcctgccgggctcggggtgggggcgtcttgcgaggaacgggcggggggggacgcacgcctaggaggcctggactgcagagtggggggccttcctccccccccgccccgctagtgggcctcggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttctacggatgctggcaaagttgtttgtgtctgagcctcacatcgcgttctacaacatgtccagagtacaaatacgaaacagacctggatccgaacacgttcagatagcgactcgttccgtgggaaagcgccggtgagatttgaaaaaagacggtaccccttgagctg

SEQ ID NO: 375254 - DNA, 370 bp, Homo sapiens
caagaagtcgagaacttcaaaaaggtcaatatgatcagccgggagcagtttgacacactgacccctgagccccctgtggatcccaaccaggaagttcctcctgggccacctcggttccagcaaggtgagaagcagacacctgagatcctgacatgggtgagaggatctagggcccttggactgggggctatcctggggtggatgccacaggcctttccctgcttcctgactcctctctctgcctctgcagttcctacggatgccctggccaacaagttgtttggtgctcctgagccctccaccatcgcccgctctctaccaaccactgtcccagagtcaccaaactaccgcaacaccaggacccctcgca

SEQ ID NO: 375255 - DNA, 467 bp, Homo sapiens
catcgtccaccaagctctgcacctcactctgcaacctctctcccttcccaattagattcaacccattaataacacattaataaccctttgcttagcccactgttcatccttcaggcttcctctcagttgacattttcttctggagcctgtttgggccctcaaatctaggttaggttaccctcctgagggctttccatcaccctgtgttttgcatctgtcactgcacttaccaccagtcttgtaggtgttgataggcttgtctctgttccacctttcagtagactgttagtgccatgaggaagaccctgggcgtgccagccttgtgcacacactctgagcatctaatagacacaaaaagaagtgggataaggaggatggtatatgggcattctctgtattatctctgcaaattttttgaaatcctaaaactattccaaaatgaaaagttcatttaaataaaaaaatgt

SEQ ID NO: 375256 - DNA, 220 bp, Homo sapiens
ttcagttcaggtacaaaacaatggctccaaaaaccaaattattaaaaaataaatgtgtcaaataccccagtattctacatactgaggcaattttgaccctaggatgcctgcctagcgcagtacagaactgagggctgtggtttaaggaaactaatatcatgacctaaattttcaacattatcaggccaccagtaaaactgtcctcatctagaaaaaaaga

SEQ ID NO: 375257 - DNA, 334 bp, Homo sapiens
tttgagacagtctccctctgttgccaggctggagtgcagcagcgcgatctcagctcactggaacctccgcctcccgggttcaagtgattcccttgcctcagcctcccgagtagctgggactacaggcgcgccttcttgtattttagtggagatgatgtttcaccatgttggccaggatggtctcgatctcctgacctcgtgatccacctgccttggcctcccaaagtgcggggattacaggagtgagccactgcgcctggcctaattttctacctccatatggaacttaaaactcagatgagctgacagaccacctaatatatgtctaactttt

SEQ ID NO: 375258 - DNA, 192 bp, Homo sapiens
caagctttgtcttgaagaaacaaagcttatctaggcctgaataagctacgctcaagcgtactcagagaagcgatttgcagattttctgaaggggcctcctggggttaagtgattaggctgaccaaggaggttatgcaagggcattatgtatcagcaaaagccaggtgggcaatgagtgaaagtaagctgtgg

SEQ ID NO: 375259 - DNA, 1933 bp, Homo sapiens
ttgaatgagtttctctctgtgttctgctacattgctggaaatagaaaccaattcacgtagctaggaaatagtctagtggttaagaacttgagcttgggagtctttaatccctcctcttcatttaccagccctgtgacctggaacaagttttttaactcttcgtttgttcctcaattgttaagagggaaatagttcctacctcacagcattactgtgagatttaagtgagatatttacaaagcacttggtacagtccctgcaatattgtaagcattccatcagaataatagctgttactaatactgccatagacacacctttactagcaaacatgaaactcacttgtggtttctaaaatcgttcattacggaatggcatttgttgactaactcttcatccacacaccgccttgtttctgtattccacagccacaggactgtgggacctggtgctttcccaaatcaggaggtgccacccccaaacctcaccagttgttccacacacggagttatccttgaaataatttcagcatcattagaatacataaaagctgtctacgtgcatactttctgatgctcttaaaacagtttcaccactctcagatcggctttggttgtttctcaacaggacagtctgtggctgtgtgagaagacctgtgagacaggaatgctgtcttctcctcagtattctccgtgggaactgacggaactgtggaaactgaaggaacggtgcggtgatccttgtcgatgtcaagcaagataacagggacttgaattagcagagtctaaaatcagggcaggcaaacgataatctgagtgcaagtctgaggagtcccagggtttagcagtagactgtatggtctttcaagagagttccagactggcactttcacccagaaccaatgcggtgtttcttaatgtttgcacaaatttccttaaaaatcaacttgtactgtagcataagaaaagtttttatttatctattggaagattatcagaaaaataccaagttattttataaaagaaaaaatatttctaaatcctgatgcattgtggctaattagtaattcaccattacctatagtttttggttaaaacttggcctagttcagaaatctgtagtagtaactgagagtttgaatttcaacctggattgcaggatagctctgtagagctaattaggataattatcagacaaaaaggaactcacaggaatgctgtgtgatcatgtgatcacatatttgagcagtggtcacttataccaaagtttggggtttctggaaataatgtcagattttgtggatctctgaagtgggcaacttgaactaacttgaagaggaaccaatatgattctcagttctgaaccttggttttaaagaagttcatttatatggtagactaatacccaaattttctttctgccatctaacataaatcctgaaggtcacagtttagtactcatagtttttaaatgctaaagttgtgtgagtatgaataaaagcaaatacctctcagggttttagtgccatcgggaaggatatttctaaattttgttgacattttgaaagaattagttttgctttcctcctatcattgcctaatgtttacctaatatgagtacatttcaatcaaagctggttatcacagaagaagatatactcagcttaggtataattgtagggaaaagcatgtgattaatttaagtactcttagaaatagtgcaactgagaagacagataatagcatattgttatacatagtagaggatgtctccccaagtttaagggacatttcccaaaatgaccaaccaaatcatttctagtaaccctttaaaatagtagtttcaatagagaattccattaaaactagtcttatgacagatattaactgtgttcagattttattaggctagctagtttctttctatttaatat

SEQ ID NO: 375260 - DNA, 1363 bp, Homo sapiens
ggtgaagatgtaagcatgggcatctggatggctgccataggacctaaaagataccaggacagtctgtggctgtgtgagaagacctgtgagacaggaatgctgtcttctcctcagtattctccgtgggaactgacggaactgtggaaactgaaggaacggtgcggtgatccttgtcgatgtcaagcaagataacagggacttgaattagcagagtctaaaatcagggcaggcaaacgataatctgagtgcaagtctgaggagtcccagggtttagcagtagactgtatggtctttcaagagagttccagactggcactttcacccagaaccaatgcggtgtttcttaatgtttgcacaaatttccttaaaaatcaacttgtactgtagcataagaaaagtttttatttatctattggaagattatcagaaaaataccaagttattttataaaagaaaaaatatttctaaatcctgatgcattgtggctaattagtaattcaccattacctatagtttttggttaaaacttggcctagttcagaaatctgtagtagtaactgagagtttgaatttcaacctggattgcaggatagctctgtagagctaattaggataattatcagacaaaaaggaactcacaggaatgctgtgtgatcatgtgatcacatatttgagcagtggtcacttataccaaagtttggggtttctggaaataatgtcagattttgtggatctctgaagtgggcaacttgaactaacttgaagaggaaccaatatgattctcagttctgaaccttggttttaaagaagttcatttatatggtagactaatacccaaattttctttctgccatctaacataaatcctgaaggtcacagtttagtactcatagtttttaaatgctaaagttgtgtgagtatgaataaaagcaaatacctctcagggttttagtgccatcgggaaggatatttctaaattttgttgacattttgaaagaattagttttgctttcctcctatcattgcctaatgtttacctaatatgagtacatttcaatcaaagctggttatcacagaagaagatatactcagcttaggtataattgtagggaaaagcatgtgattaatttaagtactcttagaaatagtgcaactgagaagacagataatagcatattgttatacatagtagaggatgtctccccaagtttaagggacatttcccaaaatgaccaaccaaatcatttctagtaaccctttaaaatagtagtttcaatagagaattccattaaaactagtcttatgacagatattaactgtgttcagattttattaggctagctagtttctttctatttaatat

SEQ ID NO: 375261 - DNA, 681 bp, Homo sapiens
gtataaaccaagttgctagaattttattttcatccatttcagtccaaccaccttccccttctccaccaagtttcagagtatacagctcctcaaattcaatttctctggagactaaaccactggtcttctgtgggtttggggactgggaaaaggaactttggtggggttggtctaagtgctacatacagtgtttctaccttctgtttttagtacagtaacttatccctgcctaccttggtactactgtacacttctaatttatgaccatctccaggattcttatggaataaaacttgtttctataaccctctctgctgccactccatttatagcttctttcattctgctaaatttaattagcatcatccagaaatgtgttaaaatctctcttcccctgttgtcttctctcttttgtatttttcgtattttattgtcattttaatgagtcagggtggagaagaaatagacacagtgtgctatagttaatcagaagcctcatggttctttttgagatggggtcttgccctgttggctaagcttgtcttggactcctgggctcaagggatcctcacaccttaacatcccaagtagctgggactacaggcacacaccaccaccaccaccacacctgagtcttgtggggttttttttagtcaatgtatttctaatttcaaaagccaa

SEQ ID NO: 375262 - DNA, 1176 bp, Homo sapiens
agactgaactgcaccttgttggtattcagctgtgatggacatagagaattggaggcaccttgttttcacaactaggataaaaataggtgttgattcttgcagggtcctttccattcctattgagagggagccctggctcaatgaccccctcccaaagtggactgtccaaagggataggctcacacgagaaacagcgagactgaaaagtggagaccgtggaatagcagtagggagtccacggagaaaacacagtgaatgttcgtaggcattcacgtgtttttgttactgctttttcgaggctgtgtcccaatgagttcactcctttcaccagacatggtcgaggttcccctctctggccagctgcagtgaatggccagcgggtttcttttctcctgggccaaggcactttgagggttgggggatagcgccggcactgcgcttggctgactgcagcgctgacacggtgtttccccaaatccctgttgcctgtgtgtttgtgtttatctgttcctagtacaggcaacataatgagatactgtgcttcccacctccccttcaattcatagccaaaatgggtctagaatctggcactttactcatttcccttgataaatgaaattgtactgtgcagagctgtcaggaccttcagatgatcgtataggactgtagctgtctaggtctgaggctgcatcttggggacacacttggttgttccccatgtgcagggttcagcacttacctgggagtggtagtggttaggcttttgagcttgaacgcccgcgtgtgaacagatgaaaaatccttcagtacccaaatccccagtcttccctttggggagcagttggggggtggctggcagcaagggcctaggaaagagaccttgcagggtgatggcagggcagcctggggcgcccagtgtagtgtgcttagtaattggtcaccagctgtcatccttggcttctcctactgtatctttgttacaagccctccgcaatccacagaactctctctccttccttccacctgtcagcttctctgcttctgagataagaaccatttctgtaacaccaatacttaagaaagacatgcattatgtggtgtaatcaaacctgatgctttcagatcatctacttacatcttcaacatggataagataaacaaaacaaatgcatctaa

SEQ ID NO: 375263 - DNA, 369 bp, Homo sapiens
gctgccgcatactactactaaattaaaaacccgtcgttaaatccaatcctgttctaaaaactaatactaaaaattacatatgatgagctcataacaaaatgatttataatgatttctccagtaagatattttggctcatatagccactccaaaatccatacatagaaaattatatcaaacaaaggatatacagctcaagatttcaaatgaatttcttacacattcttcacaagttaaattcacattccatcaggagtaagaaaaagaaggaaaacattattttctaggactctacccttagcaataacattatcttctaccttctcaagatatcaggtatgttcatagattttgtaatcaaaccaccct

SEQ ID NO: 375264 - DNA, 554 bp, Homo sapiens
tgatttacattatcattatacagtgtggattagttaatagtttttttttgttttgtttttaagagatggggtctcactgtgttgctcaggctgaacttgaactcctgagctcaagtgatcatcccacctcagcttctcatgtagctaagactataggcatgtgccactgggcccagcctggattaaagatttccacatagaccagaactagtttgaagattaggaattacttttttaggcttcattttgtgtgtttaaaaatatgtttaaaatggccaggcacggtggctcacacctgtaatcccagcacttagggaggccaaggcagacagatcactaggtcaggagatcgagaccatcctggccaacatggtgaaaccccgtctctactaaaatacaaaaaaattagccgggtgtggtggtgcgtgcctgtagtaccagctactcaggaggctgaggcaggggaatcacttgaacccgggaggcagaggttgcagtgagccgagatcacacgactgcaatccagcctggtggcagagcaagactccatctca

SEQ ID NO: 375265 - DNA, 539 bp, Homo sapiens
gcgtgccgctactactactactaaattcgcggccgcgtcgacttccttcctcacaaagttgactcatgaaagcacttaaaaaagttaaaaatgttacatactatgttctttaatcagcactaataacattaatattgatcgggcagaaggtacagcgatcatgcgggtggggaccagaattgggaattgggaattgggaaatctaggttctcagcccaacatttgcacctgctagttcgtgatgcaaggcacctcacttatccaggtccccattaaactaggtttaataaagtgagtttgcctaaacctcttcctagctccaaggctaattttaagctattaatttgaatccaaggcctaaaatatttgagctctcatttaacagtcggccactgcaaagggtaaagacagcaatcttgtatgaacaaagttaaacataacgtgctagacacaggtctttgcaaaaccatgcagtagccaataggtccaccataccacccttcatttggaaattgatgctaaggtgccataggtacatt

SEQ ID NO: 375266 - DNA, 1182 bp, Homo sapiens
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 375267 - DNA, 255 bp, Homo sapiens
  misc_feature (238)..(238): n is a, c, g, or t
ttgtcgctctagcggatctcctcagacagcggacccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacggggtccgctgtctgagngatcctcgagacaccca

SEQ ID NO: 375268 - DNA, 1111 bp, Homo sapiens
acccacgcgtcggacccacgcgtcgatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 375269 - DNA, 1132 bp, Homo sapiens
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatctatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 375270 - DNA, 771 bp, Homo sapiens
tcaaagacctcattctctgctttcagtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 375271 - DNA, 719 bp, Homo sapiens
aattcggaacgaggcgactggatccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 375272 - DNA, 1385 bp, Homo sapiens
  misc_feature (1385)..(1385): n is a, c, g, or t
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggtaaggcttggttctctcatgacacaagaagtcgacaacaaagaaaacacaaaagagaaacaaacatgtctggtggcagcgggccactaggcggccctgaagaagaaggccttaagaacaccaacacgagtaatgggcacgcgaggcccccacactacagaacaggcgagacgaggggaacaaagcgcgtacacccgagagagaan

SEQ ID NO: 375273 - DNA, 1138 bp, Homo sapiens
  misc_feature (1121)..(1121): n is a, c, g, or t
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacggggtccgctgtctgagngatcctcgagacaccca

SEQ ID NO: 375274 - DNA, 579 bp, Homo sapiens
gagcatctgtagttaggatcgcgatgagagagcaaagatgtcagggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 375275 - DNA, 1218 bp, Homo sapiens
  misc_feature (1052)..(1052): n is a, c, g, or t
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggtgccgggaggaagacgggttggcaactaaggtatttttcngccagggagcatggattggggggggatgaaggacataattggtgggaacaaaaagggctgggaaaaaaaagcaattggggcgccaacgatacacggcggcgagagagcggacgaggctgccaagggaccaaggcgacgcgacggcaatgcaaaacacagtcacgcg

SEQ ID NO: 375276 - DNA, 1382 bp, Homo sapiens
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctgggggtaagttttgtgtatttggcataaaaggagaaagagggacttaggccctgagcagtacaagaaaagcagctaagaataaaaggaataacagtgatgtcccttaagcatgttcccccagaatctgtctccaggaaggagcttctaatggaacaagaagcattgactggtagtaatctcacaggattttccttgtattgcagctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 375277 - DNA, 1091 bp, Homo sapiens
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacagctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 375278 - DNA, 299 bp, Homo sapiens
ttgtcgctctagcggatctcctcagacagcggacccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 375279 - DNA, 893 bp, Homo sapiens
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaagt

SEQ ID NO: 375280 - DNA, 455 bp, Homo sapiens
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactcagggacttgctttggagtcatggattaaagacctctctgggcagc

SEQ ID NO: 375281 - DNA, 1269 bp, Homo sapiens
ccaaaatggccggcgcgggctgacgcctgtaatcccagcaccttgggaggctgaggcaggtggatcacctgaggtcaggagttcaagaccaacctggcaacatggcgaaacccggtctctactaaaaatacaaaatcagccgggcgtggtagacatgcctgtaatcccagctactcaggacgctgaggcaggagaatcaattgaacccgggaggcggaggttgcggagttaaacatccttctacaggataactgcatctagaggcaggactatatataagcaaaggaaaagttcttcgaagaggaaacacgaatcgctcgttttaggaataaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 375282 - DNA, 1365 bp, Homo sapiens
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggtaggtccctggtgaaaaaacaaaaaaagtaaaagaataacaaagtatacaaaaaaaaaaggggggctatattcggggcagaaccatttttaagacattatatataaagacggcagacgaaagtattagacttggggacacacacataatgttctgttgatagaaaaagtagatgacgggaggaag

SEQ ID NO: 375283 - DNA, 1500 bp, Homo sapiens
  misc_feature (1184)..(1185): n is a, c, g, or t
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggtaannaaaaaaaaaaaaaaaaaaaaaaaaaaaaaattaattatttataaataaaaaaaaaaaaaaaaaaaaaaaaaaaaaaaataaaaaaaaaaaaaataaaaaaaaaaaaataaaaaacaaatttataaaaaaaaaaaaaaatttatgtctcctttcgcaccaactttttcataattaacaatatcttcttcttcgcccgcaatcttctctaattgccaaaattcttcttaatccggggctaataaaatatcttgtgcgcgtcattataacccctttaaccttgaaaaacctcggtttttcaacctttaattcctttgt

SEQ ID NO: 375284 - DNA, 1121 bp, Homo sapiens
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacagtttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 375285 - DNA, 1755 bp, Homo sapiens
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggtaggactgaataggagatggcaaagagtcaaagaaagccttaaggaagaacttcgtggcgggagggagagcatcaggaagaatagctaatggatgcttggcttgatgtctgggtgatgggatgatctatgtgtaaatcaccatggcacgtttacctatgtaacaaacctatacatcctgcatgtgtacctctgaacttaaaagatgtaaggaaaaaaaaaaaaaggaagaactttggaggcagagattttcccagggtctgctggcctagtggggtgccaggccctcctttgctgagcctaagcaaagtacttagctgaacttgttctcaattctgatcactagtagtcttcctatgcccccaagaggctgctgtgctttatggtaaactttgcatgtcaacaccttcttcatgtccctctcataggggtggcaaaatatgcctgacggatcatttcaaacctttgtgggccaggaatgtgcccaaatttggactagctcatctcatggctctgggggtaagttttgtgtatttggcataaaaggagaaagagggacttaggccctgagcagtacaagaaaagcagctaagaatgaaggagcttctaatggaacaagaagcattgactggtagtaatctcacaggattttccttgtattgcagctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 375286 - DNA, 650 bp, Homo sapiens
  misc_feature (612)..(613): n is a, c, g, or t
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgactgcttcctgcttggtgtgccagccacattccaagtccctgccnntacccagaatgacgcaccggcagcggcaaagatcgtt

SEQ ID NO: 375287 - DNA, 712 bp, Homo sapiens
agagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacgtgagtgtgatagagtgggaaatatgaaggttagtagaaggggagggattagatgatgggtaacaagctatcctttcttgaagggaccaaagaaaactttaaaaatgggagagaaaagctgaggtttgaggcaagcataagtt

SEQ ID NO: 375288 - DNA, 1682 bp, Homo sapiens
tgcccaggctggagtgcagtggcacaatcttggctcactacaacctccaccacccaggttcaagtgattctcctgcctcagcctcctgagtagctgggattacaggcttgcacctctacgcctgactaatttttgtattattagtagagacagggtttcaccatgttggccaggctggtctcaaactcatgacctcaggttatccgcccgcctcggccccccaaagtgctgggattacagacatgagccaccatgcccagcctctactagctgattttaaatcagagtaagataagtgatgcttatttatatgtaccttttctccaattccttctcactaacactgagaggaacagagaattgtcagaatagtaactattgtgataatggtatgcagcactcattcagcacttactgttacctggcactgtgtcagggactagacattattttatttatccttctagtatttcccccattttcagaagggaaccagaggcttaagattacacagctagtaggcaatagagctggaattgagcccctatctgactctagctagtgcccttaattactattgtaaatggctaggaatcgtatttgtgaggatttggtaggtttggaaaaggactttcttaatcctgatattcagaattgtcctaaaacttacataaaagcctaacctagcttttactgtattgttaggcttcagggatactatgtgacctgaaatatatacacatttttaacaagtggtccatgttttaacaggtttggccagcccttcttacaagcttcctttgtgccaaattttcattgttttttgaaatcaccaaaccatgttactaatgttgtgttttggtttgttttacagtgatccttttctgtatggctgccctaatatttccaataggattttacatcaatgaagtcggaggtcaaccttataaattacccaacaacacagtagttgggtcatcatatgtactttttgtcttatcaattttctttacaatagtaggacttctatttgctggcaaagtttgtttaccaggctgatgaatgtctaaattgcttgactcttattattttttattttattttatttttttatttttggagggtggagaggacaaaggcgaggcatctgagcaggcctctcatgggaagatgctcagatgaaactgatgctgagaaggaaaaaaaaatgctttggtttgttctcactatgcactttggatttaaaaaaaaaaaaaaaaaggagagccttttccataaccaaatacagacaatattgactaaatctcctgagcatattcaggcagtcaggtctgcactgtgatagcaacctagagaaggagaatgctttataccgaaaagcatgtggccctttgtgactctgttattccgtttttaatgtctaatgattcattagaggaaaaaaaaaagtctaagtatttatgtgtcatggtggaccagagggatgcaagagaagttcatgtggggctggcctcacctcctaagaaattagtgttcacaacttccttgtaatagtatgagcctttggcaccagaatggattgccgttgcattactgcaccaagaagccaatagatcaaaacttgtttgctaaaatgtatgtaaaaattctgaaattccctctctctgtgtacaaaaaaaaaa

SEQ ID NO: 375289 - DNA, 735 bp, Homo sapiens
cgcggggactccgggccccggcggcggcccatggggcgggaggcgtgaggccgctgcctgtccggggctcggggggtggggggagcggggcggggagatggataaactgaccatcatctcaggatgtctctttctggccgccgatatcttcgccatcgccagcatcgccaacccggactggatcaacaccggggagtctgcggtctcaccttaatccagctcagttctgtgtacaaaccatggaggttattcattcaggtgaaataaatgggttacttctgccagattaatctgggaagaaacacactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaaagtgtgtgcattcttctcatacctaagaatatcactgtaaaatctgctgaaaactatttttaggttttatttgcacaagactgaattagtttgacatttttggaagctcctattgaacatacccaaacatctgtaaacatgaaaaatcttcaatttattaaaagcaaacatttcagtatgattctttccaaagtttgctgctgattcttccttgtgtggcc

SEQ ID NO: 375290 - DNA, 1397 bp, Homo sapiens
cgcggggactccgggccccggcggcggcccatggggcgggaggcgtgaggccgctgcctgtccggggctcggggggtggggggagcggggcggggagatggataaactgaccatcatctcaggatgtctctttctggccgccgatatcttcgccatcgccagcatcgccaacccggactggatcaacaccggggagtctgcggcactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaaagtgtgtgcattcttctcatacctaagaatatcactgtaaaatctgctgaaaactatttttaggttttatttgcacaagactgaattagtttgacatttttggaagctcctattgaacatacccaaacatctgtaaacatgaaaaatcttcaatttattaaaagcaaacatttcagtatgattctttccaaaggtaatccatgttctatgttgttaatgtgtgtatgtaatttttctgactcttccacctcttataaacctattttctgtttcatttgttttgtttttgaaggatggctcttttttctttttaatgttctagatgaccaaaacactattggtttttacccttttgcctaaagctttgatatccccacttgatgttctgtgaattcactgtttaatctattaagtgaaataataaatagtcctggtgacaaacaatctgttgatttagaggaaaggccctgaaaaatacagtattggaaactaactttgcatatgctgttagctattattttgcatcatgggcttcatgggaagaacatgttgcatttattttgtctttattaaaagactactagccacaagttactctgattatagtaactgttttatcaacccacttcatctttaaaaaattaaatttacattcacaattcaaaacagtaagctgtctttcagaaaatttttgaaggataaaaacatgaaggaaaaaagtggcccgtgtaggtaggattccctacacaggacttttagttgtatcacctcaagagattttgaagtttgtgatcaaggtctgtatattatcccaaactttattaagaattgttttctaattggttataacatttttcaattaatagtttcaaaacaaattgttaatacaactgtataaaatgaacataattttcctcacttgtatttttgttattgagcaagtttatcaaaataaattgtctactaaagaaactaaaaaaaaaa

SEQ ID NO: 375291 - DNA, 259 bp, Homo sapiens
aaaaacaccaagactagaggactctgggttccttttatgcaaagtcaactcttctgggtcacagttacccagcaacaaaaataaaggtagttatttataaatggtattaaagatagaaagcacaatgtatattttttaagagttttggttcttttcccaggagaagaaaacactgtgggttggtattttcaagcacattcaagggttttacaaatcagccccagttccagtcacacacaatctaagaccacccaagata

SEQ ID NO: 375292 - DNA, 1007 bp, Homo sapiens
cgcggggactccgggccccggcggcggcccatggggcgggaggcgtgaggccgctgcctgtccggggctcggggggtggggggagcggggcggggagatggataaactgaccatcatctcaggatgtctctttctggccgccgatatcttcgccatcgccagcatcgccaacccggactggatcaacaccggggagtctgcggcactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaaccactatgagaagattataggaaaaacaccaagactagaggactctgggttccttttatgcaaagtcaactcttctgggtcacagttacccagcaacaaaaataaagaatttccccatggactccagatcctttactactgaactcacagggctgtaacactgttactgtacagagaggaccaggacgatgccagcaccccgtttatcctgagtgaactctccggaggcctcttcaagcttgtgggttctctgctgtcttgaagccatccatccatttgataggttttgcaaagacttggtcctgccaagatggttttaatcatttctgctaaaaggaatggactcgaggatttgatctcattttagatgcagttgtcctcacttggccattttacagcactttagtaaatatggccagtgtatttggtcactattaaatcaatccccattcattatctgtcagggcaactcagtgaactaaatactatgttctgacctctggcactctttctcatgttgtttaaatatttaatattgtctaaggcaattcaagtattttcttaaataaaaaatatgaaaactcaaaaaaacca

SEQ ID NO: 375293 - DNA, 1221 bp, Homo sapiens
cgcggggactccgggccccggcggcggcccatggggcgggaggcgtgaggccgctgcctgtccggggctcggggggtggggggagcggggcggggagatggataaactgaccatcatctcaggatgtctctttctggccgccgatatcttcgccatcgccagcatcgccaacccggactggatcaacaccggggagtctgcggcactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaatgatccttttctgtatggctgccctaatatttccaataggattttacatcaatgaagtcggaggtcaaccttataaattacccaacaacacagtagttgggtcatcatatgtactttttgtcttatcaattttctttacaatagtaggacttctatttgctggcaaagtttgtttaccaggctgatgaatgtctaaattgcttgactcttattattttttattttattttatttttttatttttggagggtggagaggacaaaggcgaggcatctgagcaggcctctcatgggaagatgctcagatgaaactgatgctgagaaggaaaaaaaaatgctttggtttgttctcactatgcactttggatttaaaaaaaaaaaaaaaaaggagagccttttccataaccaaatacagacaatattgactaaatctcctgagcatattcaggcagtcaggtctgcactgtgatagcaacctagagaaggagaatgctttataccgaaaagcatgtggccctttgtgactctgttattccgtttttaatgtctaatgattcattagaggaaaaaaaaaagtctaagtatttatgtgtcatggtggaccagagggatgcaagagaagttcatgtggggctggcctcacctcctaagaaattagtgttcacaacttccttgtaatagtatgagcctttggcaccagaatggattgccgttgcattactgcaccaagaagccaatagatcaaaacttgtttgctaaaatgtatgtaaaaattctgaaattccctctctctgtgtacaaaaaaaaaa

SEQ ID NO: 375294 - DNA, 654 bp, Homo sapiens
gcctggagcccgaccgtggttagactgacgggatctgggatcatgcaggagctgtgagctcagggcgctcctccagcggtggaggaatacagtgaccatcataaggtgtcacctattactgcgtccggcacggtgctaaggcatcgcatgccagatctcagtctttgtagctctaggagagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaa

SEQ ID NO: 375295 - DNA, 548 bp, Homo sapiens
tgttaaagtacgcctggaactggttcagaaaccaaaaccattacaacccttgaaggaatcgaagtgctcaagaagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaa

SEQ ID NO: 375296 - DNA, 772 bp, Homo sapiens
gcatccgccggacgccggaagtggttctccgcccctgccactgggccatggagactgtggcacagtagactgtagtgtgaggctcgcgggggcagtggccatggaggccgtgctgaacgagctggtgtctgtggaggacctgctgagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaacccccgtgtctgcgttgaggggaggggtgggttctgaaccgctgggcacagggggcggagacgtcactcctggtcctctcctgcccctgccctccaggttggcacggggttctttgtccaccccgcagcccagagcccacacccttccttcc

SEQ ID NO: 375297 - DNA, 828 bp, Homo sapiens
gtcgcccggaggttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaagggacgggaggccgcgtagaggaggggaccgtccccgagcctcgccgagcctgcggtgtagacacctctggtgtctagtggttgaggatctgttgaccgggcatggtgggtagaaggaacgctccgagcagaagaaaagtggctgtcgtgaagacatctgcgtgtgcggggtgcgtgggtgcctggagatgaagctggaaagagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggactcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaa

SEQ ID NO: 375298 - DNA, 1005 bp, Homo sapiens
gtcgcccggaggttctgagcgttctgttcggacctcctaccgttactctttcattcactcaagaaatgatttcttgagttcccggcctttgtcagagagatgaacgaggcacggtccgtgtccagctaaaggacagtaggactggaagagcgttgttttccaaggtacaggatgccgcgcctcctaggagccgaagggacgggaggccgcgtagaggaggggaccgtccccgagcctcgccgagcctgcggtgtagacacctctggtgtctagtggttgaggatctgttgaccgggcatggtgggtagaaggaacgctccgagcagaagaaaagtggctgtcgtgaagacatctgcgtgtgcggggtgcgtgggtgcctggagatgaagctggaaagaagtttgaaaagaaatttcagtctgagaaggcagcaggctcggtgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaa

SEQ ID NO: 375299 - DNA, 617 bp, Homo sapiens
gcatccgccggacgccggaagtggttctccgcccctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggtgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggacgcaactggtacggcgggcgcatctggtacggcgggcgcaactggtacgtcggg

SEQ ID NO: 375300 - DNA, 492 bp, Homo sapiens
gcatccgccggacgccggaagtggttctccgcccctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggtgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatgacagcctcggcccctttgttcagccccg

SEQ ID NO: 375301 - DNA, 581 bp, Homo sapiens
ctcctccagcggtggaggaatacagtgaccatcataaggtgtcacctattactgcgtccggcacggtgctaaggcatcgcatgccagatctcagtctttgtagctctaggaggtaggcactacttctattcctggacaataaaaggtccaggcccggcagggtggggcaggatggggccagcagcctcaaatgaggaccgcgtgggctgttgagcagttctgacagcgtgtttactgttcggccgccggggtcagctgctccgggagcggtgcctggagctgccaccaggtggcatctccgctcggtaccgccgcggggaggggagaccgggggcctctgtcccaagagctggcccgcaggcccggaggagccgaaagcctgggtcccgggcatggagatagcagaagctggggtgccagataccgagacctgcgagggaaaggggcagagccagggagatggcatgtccagatagagaatggttgacgccctacatttctaaatgattcctttcctcccctgtggcagaagtttgaaaagaaatttcagtctgagaaggcagcaggctcggtgtccaaga

SEQ ID NO: 375302 - DNA, 753 bp, Homo sapiens
gcatccgccggacgccggaagtggttctccgcccctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggtgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaa

SEQ ID NO: 375303 - DNA, 905 bp, Homo sapiens
gcatccgccggacgccggaagtggttctccgcccctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggtgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaacccccgtgtctgcgttgaggggaggggtgggttctgaaccgctgggcacagggggcggagacgtcactcctggtcctctcctgcccctgccctccaggttggcacggggttctttgtccaccccgcagcccagagcccacacccttccttcc

SEQ ID NO: 375304 - DNA, 1065 bp, Homo sapiens
gcatccgccggacgccggaagtggttctccgcccctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggtgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaaaaaaaaaaaaaaacacaaagagcgcgcgaccgcagaacaacacggcacgcacaagcaaccccgagggggggcccggacccatacggccaacaggggtcgtatgcacccacggacggggatacaactcacgagggaccaccgggggtgcccaacaacgactgaacacaccgcttgcagcgcgcgaaagccaacggaggctccaagggccccgaaggagcacgaggaaacgggaccgcagatggcaccccgcttacggcgaggacctaaccgcgggcggcatgagccaacgcgcccggcgggcgcacatggggc

SEQ ID NO: 375305 - DNA, 701 bp, Homo sapiens
gcatccgccggacgccggaagtggttctccgcccctgccactgggccatggagactgtggcacagtagactgtagtgtgaggctcgcgggggcagtggccatggaggccgtgctgaacgagctggtgtctgtggaggacctgctggcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaa

SEQ ID NO: 375306 - DNA, 682 bp, Homo sapiens
gcatccgccggacgccggaagtggttctccgcccctgccactgggccatggagactgtggcacagtagactgtagtgtgaggctcgcgggggcagtggccatggaggccgtgctgaacgagctggtgtctgtggaggacctgctggtgaggcctggcccggacagagggaaagggaaggtcggagggcgggtcctgaggagagtcagagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaa

SEQ ID NO: 375307 - DNA, 620 bp, Homo sapiens
gcatccgccggacgccggaagtggttctccgcccctgccactgggccatggagactgtggcacagtagactgtagtgtgaggctcgcgggggcagtggccatggaggccgtgctgaacgagctggtgtctgtggaggacctgctgagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaa

SEQ ID NO: 375308 - DNA, 1833 bp, Homo sapiens
ggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgag

SEQ ID NO: 375309 - DNA, 2225 bp, Homo sapiens
attaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgag

SEQ ID NO: 375310 - DNA, 624 bp, Homo sapiens
ctgagtttccagaatttttttgttgttgttcacagcccagattcacctcttcctttccgctcctgtctagagaggagtgggagggagagtacccctgcaggagaaggcctgcaaggccaggaccacagagggcttgtggttccttcagctcaggggcttttcactttgccagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggtgagtggcggtgggaaggagctcgcagaaggaggctgtgatcatgaggccggagcaggtctgcccacagtggggaagggctgatgtggtaagcctgccaccccagatcgctcctggcccgagcacagagcatctcttacccattggctctctctcttccttttatcccacttctgccatcccatatggttgagttttctgtctcgctgataagatatttttctgagttttttcagcccagctctgatctcactgtgagaattttctaagatcctgaccctctgttctgtcttctcagcttcagttacc

SEQ ID NO: 375311 - DNA, 582 bp, Homo sapiens
ggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtactgcctgtgcctgctgcttgaatatttccgccttttagggtgctcgcgcaggaggctgcagcgggggatgggtgctccgaggctcccgaggcccgcgcaggtcacgggtgcctccggctgtgcattctacctgcaggtcctttgacaccagagtgtttaggtttcaacacctctcccgctaggtaacaggaagcagatgagctccgtaacaacagacacacggacttgtcagattccttgttcgtatcagggttcttgcacagttaggacgg

SEQ ID NO: 375312 - DNA, 400 bp, Homo sapiens
agagagaaagaccctatttcaaaggtggccccaagcgctgctcgaggggtgcttctgtgacggcgcagcatgtgtgcccaggcctggttcctcacggccaggcccatcatcactcactggctttttccttcctcgtgttagattggagctggagggagcatcactgggctgaagtttaaccctctcaataccaaccagttttacgcctcctcaatggagggaacaactaggctgcaagactttaaaggcaacattctacgagtttttgccagctcagacaccatcaagtgagtagtttaactagcaggggaaagggcttctaagcttaggtgtagttccggcaagagcatccagatcccatttccttaacccaacctggcccagggaagaaaggaaagat

SEQ ID NO: 375313 - DNA, 511 bp, Homo sapiens
cccctcctatcatgcacatcataatcatatttaaagcgagcagaagaaaaattacatagtacaggaacataaggatagtagcagacttctcatcaggatgtctcgttttgttttgtttttacttgagacaggatcttgctctgtcacccaggtttgcctagctcactgaagccttgtccccctgggctcaagcgattctcccacctcagcctcctgagtagctggcactacatgcacaggccaccatacctggctaattttaaaattttgttatagagacagaggtctcactgtgttgcacaggctggtttcaaactcctggcctcaagctatcctcctgccttagcctcccaaagtgccgggattataggcgtgagcccctgcacccagccacattgtactgatatgatacagtttattcatttacctgttcaaggacatttgaatttttttctagtttttgaatgcaacatataaagcgactgtgaacattcacgtacaagtatttgtg

SEQ ID NO: 375314 - DNA, 2051 bp, Homo sapiens
ggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaagtagggacggggtttcaccatgttagccaggatggtctcgatctcctgacctcgtgatccgcctgcctcagcctcccaaagtgttgagattacaggtgtgagccactgcactcagcccaaagaatacttttgatgttcctctttgttcatatttgtttttgatgtcccccttgatcatgttctgtgtttaccctcatggccggcctctccatctcctaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgag

SEQ ID NO: 375315 - DNA, 1841 bp, Homo sapiens
ggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtacatgctcactcacccagttacaccctttgtcacgatttacgatcccctccatacacctatcccaatcgacacaatcac

SEQ ID NO: 375316 - DNA, 2368 bp, Homo sapiens
attaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccgaccacacagacatggaaaggccgcaggaggttgatgagacagagattaaccgtgccgaatgaaacaaggcttcctttcggggaattcagcagaaaaacctttcgtgagattggagaggaaaatatgtctgttctgcttggcaggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgag

SEQ ID NO: 375317 - DNA, 2172 bp, Homo sapiens
attaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattatcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgag

SEQ ID NO: 375318 - DNA, 1512 bp, Homo sapiens
ggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggtgagtggcggtgggaaggagctcgcagaaggaggctgtgatcatgaggccggagcaggtctgcccacagtggggaagggctgatgtggtaagcctgccaccccagatcgctcctggcccgagcacagagcatctcttacccattggctctctctcttccttttatcccacttctgccatcccatatggttgagttttctgtctcgctgataagatatttttctgagttttttcagcccagctctgatctcactgtgagaattttctaagatcctgaccctctgttctgtcttctcagcttcagttacc

SEQ ID NO: 375319 - DNA, 2495 bp, Homo sapiens
aatttacgaagtacagatcgagtgaacaatgcacaaaatgaaacagggaaaaagacaaaaatgaacagtgcatcaaccacctgcaggaccatatgtaatcgcagtcccaagaaaaaaagaactgttctttttcttcattttgaactctttgaaagaaatgaaggggccagacaaagcggctcatgcctgtaatcttagcactttgggaagccgtggcagggggatcgcttgagcttaggagttcaagaccagcttgggcaactttgccttcttagtttgtcttgcaggtttcagtgcttctaataataaaaataagtcttttattttcccaccttttctcaggctcttgttaatagcttctctatcattagtccccaacactaatagctttcaagtcctttgatgcctttttgcctaagcccccatgcagactgagctctgctagttctgcattcttttccaaaactacagatcctcttcagatcttcaggttttatgcctatacttctctggtcagttcagaatagtggtggggagcgccagtttccagcagccagaccccccgggttagaatccttgggcaaattacttatattttggatctgtttcctcatctgcaaaaagggaatactagtctctaactgatagggttgttgtgaagatgagtcagtatacttaaagcacttggccccatgcccagcacctggtaagtactggtaagtattcaataaatgatgattgaatattgagtggcccccacgtacctcaatcacatccaagctcttaataaataatgtcaagaatccttccccagttggtgttcctgttaatccatcagtgttcccgataatccatctgtctgcatgtcccagtttgtatctagccaggtgtcgtaagtcattacagcttcctgtgtgtgatttgtgacttatttctaagccttcgcatgtactatttcttccttcctgctaaccatgtctttcttccttcaaaacttccttgagaagtttaggaaaatcccatccaattctgccattttaataactgccagatttgtttttagtggggtgatctggggaatgtgggtttccttctcttttttagccattagcaattttacactcagctcttagttattcgtgttgatggagacaggatgacagtggggctcctccagaactcaagtcctgttagggtttggtcaccagaggctttttctgctttgttgtaggcctcttaggtcagtatctgggtcaggctgatgttaaaatgtttaccagttggtatgatcttaggaaatgcaaatgagggagaaggcctgaaggtgccctaagggccagggaggccagctagggattaaaaatgtgcaatggcagaggcacacacaacctaaaaccattcttgtagttttctgtaagacttatctccattattaggttggcttgttacctggccaatactacttttttttttttttttttgagagtcttgctctgtcacctaggctggagtgcagtgacatgatcttcactcactgcaacctccgcctcccgggttcaagtgattcccctgcctcagcctcccaagtagctgggactacaggcatgtaccaccacgcccagctaattttttttttggtatttttagtagggacggggtttcaccatgttagccaggatggtctcgatctcctgacctcgtgatccgcctgcctcagcctcccaaagtgttgagattacaggtgtgagccactgcactcagcccaaagaatacttttgatgttcctctttgttcatatttgtttttgatgtcccccttgatcatgttctgtgtttaccctcatggccggcctctccatctcctaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgag

SEQ ID NO: 375320 - DNA, 2355 bp, Homo sapiens
tatagagatggggttttgccatgttgcccaagctggtcttgaactcctaggttgaagccatcccccaaccttggcctcccaaagtgctaggattacaggcatgagccactgcgcctggcaactttgccttcttagtttgtcttgcaggtttcagtgcttctaataataaaaataagtcttttattttcccaccttttctcaggctcttgttaatagcttctctatcattagtccccaacactaatagctttcaagtcctttgatgcctttttgcctaagcccccatgcagactgagctctgctagttctgcattcttttccaaaactacagatcctcttcagatcttcaggttttatgcctatacttctctggtcagttcagaatagtggtggggagcgccagtttccagcagccagaccccccgggttagaatccttgggcaaattacttatattttggatctgtttcctcatctgcaaaaagggaatactagtctctaactgatagggttgttgtgaagatgagtcagtatacttaaagcacttggccccatgcccagcacctggtaagtactggtaagtattcaataaatgatgattgaatattgagtggcccccacgtacctcaatcacatccaagctcttaataaataatgtcaagaatccttccccagttggtgttcctgttaatccatcagtgttcccgataatccatctgtctgcatgtcccagtttgtatctagccaggtgtcgtaagtcattacagcttcctgtgtgtgatttgtgacttatttctaagccttcgcatgtactatttcttccttcctgctaaccatgtctttcttccttcaaaacttccttgagaagtttaggaaaatcccatccaattctgccattttaataactgccagatttgtttttagtggggtgatctggggaatgtgggtttccttctcttttttagccattagcaattttacactcagctcttagttattcgtgttgatggagacaggatgacagtggggctcctccagaactcaagtcctgttagggtttggtcaccagaggctttttctgctttgttgtaggcctcttaggtcagtatctgggtcaggctgatgttaaaatgtttaccagttggtatgatcttaggaaatgcaaatgagggagaaggcctgaaggtgccctaagggccagggaggccagctagggattaaaaatgtgcaatggcagaggcacacacaacctaaaaccattcttgtagttttctgtaagacttatctccattattaggttggcttgttacctggccaatactacttttttttttttttttttgagagtcttgctctgtcacctaggctggagtgcagtgacatgatcttcactcactgcaacctccgcctcccgggttcaagtgattcccctgcctcagcctcccaagtagctgggactacaggcatgtaccaccacgcccagctaattttttttttggtatttttagtagggacggggtttcaccatgttagccaggatggtctcgatctcctgacctcgtgatccgcctgcctcagcctcccaaagtgttgagattacaggtgtgagccactgcactcagcccaaagaatacttttgatgttcctctttgttcatatttgtttttgatgtcccccttgatcatgttctgtgtttaccctcatggccggcctctccatctcctaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgag

SEQ ID NO: 375321 - DNA, 1088 bp, Homo sapiens
  misc_feature (26)..(26): n is a, c, g, or t
ccaggctggtacagcccgcggggtancgatatcgtcgacccacgcgctccgaggcaacattctacgacgttttgccagctcagacaccagtggagcatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgag

SEQ ID NO: 375322 - DNA, 1376 bp, Homo sapiens
attaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaaggggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatccatgggaaaggtggctctggatgggtacaatttcattgcggcaggggagcggaagaggggagaactagaggggggaaggctgggccaagggtagcctcgaggggtgttagggcccaccaggggggaggcggaggcggggggaattggggcaagaaggggaggtttga

SEQ ID NO: 375323 - DNA, 1414 bp, Homo sapiens
attaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggacagggtcttgctgtgtcacccagggatgatcatggttcagcatagcctcaacctcctcagctcaagcgattctcccacctcagcctcctgagtagctggcactacatgcacaggccaccatacctggctaattttaaaattttgttatagagacagaggtctcactgtgttgcacaggctggtttcaaactcctggcctcaagctatcctcctgccttagcctcccaaagtgccgggattataggcgtgagcccctgcacccagccacattgtactgatatgatacagtttattcatttacctgttcaaggacatttgaatttttttctagtttttgaatgcaacatataaagcgactgtgaacattcacgtacaagtatttgtg

SEQ ID NO: 375324 - DNA, 339 bp, Homo sapiens
cctagtatttctttaccaaattgtaggtttgcgggccagccccaggctctgagagattggtaacagaaagtgtaagtcagactggtctcactcttcctaggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctcca

SEQ ID NO: 375325 - DNA, 538 bp, Homo sapiens
tcattcaacaaatatttattgaatgcccgctgtgggttagtcaccggagcggcaacagtgagtaaataggactatctctgtccccaagaatcttacaacacagtctctccctccagcatctggttttgtagcctggatgtgtctgctagtagccgaatggtggtcacaggagacaacgtggggaacgtgatcctgctgaacatggacggcaaagagtgcgttctccgaggtcctgcctttccctccctcacccccacctcggttctgtgtccccacctgaaccgagctcttctctgcagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcaggtgtgatatcccagacctcatctctcctgcagaccctgcctgtctgaccactgctggggtt

SEQ ID NO: 375326 - DNA, 1655 bp, Homo sapiens
ggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgag

SEQ ID NO: 375327 - DNA, 1865 bp, Homo sapiens
ggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgagaaaactgcgtggatcttccagaagtgacctgg

SEQ ID NO: 375328 - DNA, 1749 bp, Homo sapiens
ggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaagtagggacggggtttcaccatgttagccaggatggtctcgatctcctgacctcgtgatccgcctgcctcagcctcccaaagtgttgagattacaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgag

SEQ ID NO: 375329 - DNA, 1807 bp, Homo sapiens
ggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgagaaaactgcgtggatcttccagaagtgacctgg

SEQ ID NO: 375330 - DNA, 1254 bp, Homo sapiens
tcattcattcaacaaatatttattgaatgcccgctgtgggttagtcaccggagcggcaacagtgagtaaataggactatctctgtccccaagaatcttacaacacagtctctccctccagcatctggttttgtagcctggatgtgtctgctagtagccgaatggtggtcacaggagacaacgtggggaacgtgatcctgctgaacatggacggcaaagagtgcgttctccgaggtcctgcctttccctccctcacccccacctcggttctgtgtccccacctgaaccgagctcttctctgcagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgag

SEQ ID NO: 375331 - DNA, 1007 bp, Homo sapiens
  misc_feature (884)..(884): n is a, c, g, or t
ggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagangccaaaagaattgacgcggtggctgaacctgtggatggtccgcacagctcgtaatcacggggattggccggccggtaagaaccagtcctaacggcgaagtcgtagcgggttcccgggagcgtc

SEQ ID NO: 375332 - DNA, 120 bp, Homo sapiens
cctggaccggctggtagcaagatttatgtttcagaatattgcaacataacttccttccctctgttgcctttgtgcattgtttgaaggaggagaataaaggactacttttgcagcacagca

SEQ ID NO: 375333 - DNA, 2253 bp, Homo sapiens
  misc_feature (41)..(41): n is a, c, g, or t
  misc_feature (55)..(55): n is a, c, g, or t
  misc_feature (58)..(58): n is a, c, g, or t
gtgacgcccccccacccctccacctttgcccggagcgcggnatgcagccagcgcncangccggccccggggcaggagcggtgctaggcaggggtggggtggccgaggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcgtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatg

SEQ ID NO: 375334 - DNA, 248 bp, Homo sapiens
catggtgactgggtgaatgcctgggtgctgggattctcgtaacctagtttccttgcatgtgagagctgtttacatttcctttgtgtttaatctctctgtttctgtactagcctcacattaaactcaatgtgtgtgagcgcgtgtgtgtgtttgcgtgtgtgtgtgcgtgtgtatgtgtgtgttcctaataacaatgcaaatgcagcagagagctggtcttgataacttttcagcacagaaacatgatt

SEQ ID NO: 375335 - DNA, 362 bp, Homo sapiens
gtgtctagtcatatacaggtcttagcaagaaagaaagttcgagaaattcaagccgccattaaggtacgtctggcttgcccacttgtagggggcttttcatctccatggttacaggcttttcctttgttttcctcccttcccctaccctgcaggtgtctagtcacattcaggttcttgccagaaggaaatctcgtgattttcattccaagctaaaggtatgcgcttttctgctttttggcttgtggttgctatgcatctcacttcctgttttccatggtgactgggtgaatgcctgggtgctgggattctcgtaacctagtttccttgcatgtgagagctgtttacatttcctttgtgtttaa

SEQ ID NO: 375336 - DNA, 205 bp, Homo sapiens
ggaaaacttcacaattttattggtaatggttttgtctctttcctctgtgggcagatgctgccatgaggcttgacagaagtgaggaaggtgggcctgggaggcgctgggcctgcgccgagggaactgaccaggttgttggattgggttcctagtggtcagtcagcagttgaatttgcatcatccatagggaaaacttgggcttgat

SEQ ID NO: 375337 - DNA, 311 bp, Homo sapiens
aaattagcccagcatggtggcaggtgcctgtggtcctagcttactggggaggctgagctgggaggattgcttgaacccaggaggttgaggctgccgtgagctgtggctatgccactgtactccagcctgggcaacagagcaagaccctgtctccaaaaacaaaaacaaacgaaaaaacaaaacacaaaaaacccaggatgacctattagaaggctgttagagtaatccatgttggtttagactatgattatggcaagagaggtgataagaagtggtcagattgtatatatcttcttttgaaggtagagcca

SEQ ID NO: 375338 - DNA, 4136 bp, Homo sapiens
caatgttcccgagcctgatggacatatcatatcaccactgttggcaggattttatatgttttggaccatgatcattttgttacaggtcttgattcctatttctctctatgtttccatcgaaattgtgaagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccagagcaggtcatggtggactttgctgctttgggaccattaacatttcaactcctacacatactgccctttgactcagtaagaaaaagaatgtctgttgtggtccgacaccctctttccaatcaagttgtggtgtatacgaaaggcgctgattctgtgatcatggagttactgtcggtggcttccccagatggagcaagtctggagaaacaacagatgatagtaagggagaaaacccagaagcacttggatgactatgccaaacaaggccttcgtactttatgtatagcaaagaaggtcatgagtgacactgaatatgcagagtggctgaggaatcattttttagctgaaaccagcattgacaacagggaagaattactacttgaatctgccatgaggttggagaacaaacttacattacttggtgctactggcattgaagaccgtctgcaggagggagtccctgaatctatagaagctcttcacaaagcgggcatcaagatctggatgctgacaggggacaagcaggagacagctgtcaacatagcttatgcatgcaaactactggagccagatgacaagctttttatcctcaatacccaaagtaaagatgcctgtgggatgctgatgagcacaattttgaaagaacttcagaagaaaactcaagccctgccagagcaagtgtcattaagtgaagatttacttcagcctcctgtcccccgggactcagggttacgagctggactcattatcactgggaagaccctggagtttgccctgcaagaaagtctgcaaaagcagttcctggaactgacatcttggtgtcaagctgtggtctgctgccgagccacaccgctgcagaaaagtgaagtggtgaaattggtccgcagccatctccaggtgatgacccttgctattggtgatggtgccaatgatgttagcatgatacaagtggcagacattgggataggggtctcaggtcaagaaggcatgcaggctgtgatggccagtgactttgccgtttctcagttcaaacatctcagcaagctccttcttgtccatggacactggtgttatacacggctttccaacatgattctctattttttctataagaatgtggcctatgtgaacctccttttctggtaccagttcttttgtggattttcaggaacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggcatacttaccccataccttctggatcaccttattggatgctttttatcaaagcctggtctgcttctttgtgccttattttacctaccagggctcagatactgacatctttgcatttggaaaccccctgaacacagccgctctgttcatcgttctcctccatctggtcattgaaagcaagagtttgacttggattcacttgctggtcatcattggtagcatcttgtcttattttttatttgccatagtttttggagccatgtgtgtaacttgcaacccaccatccaacccttactggattatgcaggagcacatgctggatccagtattctacttagtttgtatcctcacgacgtccattgctcttctgcccaggtttgtatacagagttcttcagggatccctgtttccatctccaattctgagagctaagcactttgacagactaactccagaggagaggactaaagctctcaagaagtggagaggggctggaaagatgaatcaagtgacatcaaagtatgctaaccaatcagctggcaagtcaggaagaagacccatgcctggcccttctgctgtatttgcaatgaagtcagcaagttcctgtgctattgagcaaggaaacttatctctgtgtgaaactgctttagatcaaggctactctgaaactaaggcctttgagatggctggaccctccaaaggtaaagaaagctagataccctccttggagttgcaagtattctttcaaggttggaagagggattttgaagaggtatctctccaagcaagaatgacttgtttttccataagggacatgagcattttactaggcttggaagagctgacatgatgagcattattgtatgtttgtatatacatttgtgatagagggctagagtttgacctagagagagtttaaggaagtgaaatatttaattcagaaccaaatgcttttgtaaaactttttggattttgtaaaagcattttcattctcttagaaattcaagtattttcaaggggagtcatttgagatatatttattttactaggagatcttatattctagggaaatgctttaaatggtcaggctccagtcggaatttttttaagaaaaaagtagtttttaatacattggttaggactcagaggaaatacggaaaaaacattgtagatggttaatttacagataaaatcccaagagccttttaaacaacaaggtacctaaaatagggtataattatactgcttaaaatacagttagtgcctattaatagctttttatttcctatgggaagatgcttttggtcttctggctgaagatgtaggcatacctctcactcatttcaatgttttcctgaggtggagccttcattggaaaggggaaagagggattctagggtttcatcagggaccaggaatgcattcctctgtcaggttccaatcaagagaagaccttttatgagatctgcctctgtatagatgttgtcagttaggaaactgaagccataggtcaggcagacatcagctcagcctgtggcccattgggtgatttcctgtattttaaaactgacagtagcctgatcaaagtgatacaatcaatttcaaaacaatcttccagagaccacttgaaggttcatagtttttacaataccctgagacttttcaggtgttggagcctctaaaatatgagatataaacagaaactaatacaagttgttctctggaggtttctatgaggttcttagaaaaatttggttttaaaatcatttgaggacaggaatgtctatagcaagtttactcctattgcgaatcatgtatgctggctttagttgtaacaaacgattttattctaagtaaggccaggtgctactataaaatcatatattcctgttgaagttcttttgaagtcctatctctatttattatatttgaaagttgtcagccaccagtcatccagaatttccttcctgaatctccatgctcatatgcaatgtctacatcaaggtcttcttaatgactattattctcagggtttagttttctaccttctgcctactattttggtctgacatttttgtagccttctgttattattggaaatagtctcttacataagctgatttcgagaactttcaaaatctcacatagctaatggaagttgctttctgctttcttatgactgtttttataaataaactgtttcataaataatgta

SEQ ID NO: 375339 - DNA, 473 bp, Homo sapiens
aatttagttttacagaattcaaatggtgatgtaattcattcacaaaaaatactcccatctccttgatatcttatattttgtttattcaggtttgttacaccattcatccagtgcttagatgtgttgtctctttaatggagcagatttgtccgggtggcaatactgtatcagtgacagagcattcatttcctctgctcttcttgtcttacagacttggattcacttgctggtcatcattggtagcatcttgtcttattttttatttgccatagtttttggagccatgtgtgtaacttgcaacccaccatccaacccttactggattatgcaggagcacatgctggatccagtattctacttagtttgtatcctcacgacgtccattgctcttctgcccaggtatggtatttattttatcattgagagaataaatggaatcataggctaagaatccttcaagcaactacactact

SEQ ID NO: 375340 - DNA, 4075 bp, Homo sapiens
caatgttcccgagcctgatggacatatcatatcaccactgttggcaggattttatatgttttggaccatgatcattttgttacaggtcttgattcctatttctctctatgtttccatcgaaattgtgaagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccagagcaggtcatggtggactttgctgctttgggaccattaacatttcaactcctacacatactgccctttgactcagtaagaaaaagaatgtctgttgtggtccgacaccctctttccaatcaagttgtggtgtatacgaaaggcgctgattctgtgatcatggagttactgtcggtggcttccccagatggagcaagtctggagaaacaacagatgatagtaagggagaaaacccagaagcacttggatgactatgccaaacaaggccttcgtactttatgtatagcaaagaaggtcatgagtgacactgaatatgcagagtggctgaggaatcattttttagctgaaaccagcattgacaacagggaagaattactacttgaatctgccatgaggttggagaacaaacttacattacttggtgctactggcattgaagaccgtctgcaggagggagtccctgaatctatagaagctcttcacaaagcgggcatcaagatctggatgctgacaggggacaagcaggagacagctgtcaacatagcttatgcatgcaaactactggagccagatgacaagctttttatcctcaatacccaaagtaaagatgcctgtgggatgctgatgagcacaattttgaaagaacttcagaagaaaactcaagccctgccagagcaagtgtcattaagtgaagatttacttcagcctcctgtcccccgggactcagggttacgagctggactcattatcactgggaagaccctggagtttgccctgcaagaaagtctgcaaaagcagttcctggaactgacatcttggtgtcaagctgtggtctgctgccgagccacaccgctgcagaaaagtgaagtggtgaaattggtccgcagccatctccaggtgatgacccttgctattggtgatggtgccaatgatgttagcatgatacaagtggcagacattgggataggggtctcaggtcaagaaggcatgcaggctgtgatggccagtgactttgccgtttctcagttcaaacatctcagcaagctccttcttgtccatggacactggtgttatacacggctttccaacatgattctctattttttctataagaatgtggcctatgtgaacctccttttctggtaccagttcttttgtggattttcaggaacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggcatacttaccccataccttctggatcaccttattggatgctttttatcaaagcctggtctgcttctttgtgccttattttacctaccagggctcagatactgacatctttgcatttggaaaccccctgaacacagccgctctgttcatcgttctcctccatctggtcattgaaagcaagagtttgtttttggagccatgtgtgtaacttgcaacccaccatccaacccttactggattatgcaggagcacatgctggatccagtattctacttagtttgtatcctcacgacgtccattgctcttctgcccaggtttgtatacagagttcttcagggatccctgtttccatctccaattctgagagctaagcactttgacagactaactccagaggagaggactaaagctctcaagaagtggagaggggctggaaagatgaatcaagtgacatcaaagtatgctaaccaatcagctggcaagtcaggaagaagacccatgcctggcccttctgctgtatttgcaatgaagtcagcaagttcctgtgctattgagcaaggaaacttatctctgtgtgaaactgctttagatcaaggctactctgaaactaaggcctttgagatggctggaccctccaaaggtaaagaaagctagataccctccttggagttgcaagtattctttcaaggttggaagagggattttgaagaggtatctctccaagcaagaatgacttgtttttccataagggacatgagcattttactaggcttggaagagctgacatgatgagcattattgtatgtttgtatatacatttgtgatagagggctagagtttgacctagagagagtttaaggaagtgaaatatttaattcagaaccaaatgcttttgtaaaactttttggattttgtaaaagcattttcattctcttagaaattcaagtattttcaaggggagtcatttgagatatatttattttactaggagatcttatattctagggaaatgctttaaatggtcaggctccagtcggaatttttttaagaaaaaagtagtttttaatacattggttaggactcagaggaaatacggaaaaaacattgtagatggttaatttacagataaaatcccaagagccttttaaacaacaaggtacctaaaatagggtataattatactgcttaaaatacagttagtgcctattaatagctttttatttcctatgggaagatgcttttggtcttctggctgaagatgtaggcatacctctcactcatttcaatgttttcctgaggtggagccttcattggaaaggggaaagagggattctagggtttcatcagggaccaggaatgcattcctctgtcaggttccaatcaagagaagaccttttatgagatctgcctctgtatagatgttgtcagttaggaaactgaagccataggtcaggcagacatcagctcagcctgtggcccattgggtgatttcctgtattttaaaactgacagtagcctgatcaaagtgatacaatcaatttcaaaacaatcttccagagaccacttgaaggttcatagtttttacaataccctgagacttttcaggtgttggagcctctaaaatatgagatataaacagaaactaatacaagttgttctctggaggtttctatgaggttcttagaaaaatttggttttaaaatcatttgaggacaggaatgtctatagcaagtttactcctattgcgaatcatgtatgctggctttagttgtaacaaacgattttattctaagtaaggccaggtgctactataaaatcatatattcctgttgaagttcttttgaagtcctatctctatttattatatttgaaagttgtcagccaccagtcatccagaatttccttcctgaatctccatgctcatatgcaatgtctacatcaaggtcttcttaatgactattattctcagggtttagttttctaccttctgcctactattttggtctgacatttttgtagccttctgttattattggaaatagtctcttacataagctgatttcgagaactttcaaaatctcacatagctaatggaagttgctttctgctttcttatgactgtttttataaataaactgtttcataaataatgta

SEQ ID NO: 375341 - DNA, 2557 bp, Homo sapiens
caatgttcccgagcctgatggacatatcatatcaccactgttggcaggattttatatgttttggaccatgatcattttgttacaggtcttgattcctatttctctctatgtttccatcgaaattgtgaagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccagagcaggtcatggtggactttgctgctttgggaccattaacatttcaactcctacacatactgccctttgactcagtaagaaaaagaatgtctgttgtggtccgacaccctctttccaatcaagttgtggtgtatacgaaaggcgctgattctgtgatcatggagttactgtcggtggcttccccagatggagcaagtctggagaaacaacagatgatagtaagggagaaaacccagaagcacttggatgactatgccaaacaaggccttcgtactttatgtatagcaaagaaggtcatgagtgacactgaatatgcagagtggctgaggaatcattttttagctgaaaccagcattgacaacagggaagaattactacttgaatctgccatgaggttggagaacaaacttacattacttggtgctactggcattgaagaccgtctgcaggagggagtccctgaatctatagaagctcttcacaaagcgggcatcaagatctggatgctgacaggggacaagcaggagacagctgtcaacatagcttatgcatgcaaactactggagccagatgacaagctttttatcctcaatacccaaagtaaagatgcctgtgggatgctgatgagcacaattttgaaagaacttcagaagaaaactcaagccctgccagagcaagtgtcattaagtgaagatttacttcagcctcctgtcccccgggactcagggttacgagctggactcattatcactgggaagaccctggagtttgccctgcaagaaagtctgcaaaagcagttcctggaactgacatcttggtgtcaagctgtggtctgctgccgagccacaccgctgcagaaaagtgaagtggtgaaattggtccgcagccatctccaggtgatgacccttgctattggtgatggtgccaatgatgttagcatgatacaagtggcagacattgggataggggtctcaggtcaagaaggcatgcaggctgtgatggccagtgactttgccgtttctcagttcaaacatctcagcaagctccttcttgtccatggacactggtgttatacacggctttccaacatgattctctattttttctataagaatgtggcctatgtgaacctccttttctggtaccagttcttttgtggattttcaggaacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggcatacttaccccataccttctggatcaccttattggatgctttttatcaaagcctggtctgcttctttgtgccttattttacctaccagggctcagatactgacatctttgcatttggaaaccccctgaacacagccgctctgttcatcgttctcctccatctggtcattgaaagcaagagtttgaccaggtgcagtgactcacacctgcaattccagagctttgggaggctgtggatcacatgaagctaagagttcaagaccagcctgggcaacatagtgagaccctgtctctaaaaaaaataacaaaactaactgtgtgtcatggcacctgccagcagtcttggccacttgggagactgaggaggaggctcacttgagcccaacagttggaggctgcagtaagctatgatcatgccactgcactccagcttgggaaacagagagaaaccttgtctctaaaaacaaaaaagtgtgattatcttattcatgtttatcttccgcattagcctatgctctctgcgagggtagggttcatgcctattttgttcaccactgtataccagtgttaaaggacaagactgacacacagcaggtgctcaaaaaatatttgaatggataaataaatgatgaaa

SEQ ID NO: 375342 - DNA, 4673 bp, Homo sapiens
caatgttcccgagcctgatggacatatcatatcaccactgttggcaggattttatatgttttggaccatgatcattttgttacaggtcttgattcctatttctctctatgtttccatcgaaattgtgaagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccagagcaggtcatggtggactttgctgctttgggaccattaacatttcaactcctacacatactgccctttgactcagtaagaaaaagaatgtctgttgtggtccgacaccctctttccaatcaagttgtggtgtatacgaaaggcgctgattctgtgatcatggagttactgtcggtggcttccccagatggagcaagtctggagaaacaacagatgatagtaagggagaaaacccagaagcacttggatgactatgccaaacaaggccttcgtactttatgtatagcaaagaaggtcatgagtgacactgaatatgcagagtggctgaggaatcattttttagctgaaaccagcattgacaacagggaagaattactacttgaatctgccatgaggttggagaacaaacttacattacttggtgctactggcattgaagaccgtctgcaggagggagtccctgaatctatagaagctcttcacaaagcgggcatcaagatctggatgctgacaggggacaagcaggagacagctgtcaacatagcttatgcatgcaaactactggagccagatgacaagctttttatcctcaatacccaaagtaaagatgcctgtgggatgctgatgagcacaattttgaaagaacttcagaagaaaactcaagccctgccagagcaagtgtcattaagtgaagatttacttcagcctcctgtcccccgggactcagggttacgagctggactcattatcactgggaagaccctggagtttgccctgcaagaaagtctgcaaaagcagttcctggaactgacatcttggtgtcaagctgtggtctgctgccgagccacaccgctgcagaaaagtgaagtggtgaaattggtccgcagccatctccaggtgatgacccttgctattggtgatggtgccaatgatgttagcatgatacaagtggcagacattgggataggggtctcaggtcaagaaggcatgcaggctgtgatggccagtgactttgccgtttctcagttcaaacatctcagcaagctccttcttgtccatggacactggtgttatacacggctttccaacatgattctctattttttctataagaatgtggcctatgtgaacctccttttctggtaccagttcttttgtggattttcaggaacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggcatacttaccccataccttctggatcaccttattggatgctttttatcaaagcctggtctgcttctttgtgccttattttacctaccagggctcagatactgacatctttgcatttggaaaccccctgaacacagccgctctgttcatcgttctcctccatctggtcattgaaagcaagagtttgacttggattcacttgctggtcatcattggtagcatcttgtcttattttttatttgccatagtttttggagccatgtgtgtaacttgcaacccaccatccaacccttactggattatgcaggagcacatgctggatccagtattctacttagtttgtatcctcacgacgtccattgctcttctgcccaggtttgtatacagagttcttcagggatccctgtttccatctccaattctgagagctaagcactttgacagactaactccagaggagaggactaaagctctcaagaagtggagaggggctggaaagatgaatcaagtgacatcaaagtatgctaaccaatcagctggcaagtcaggaagaagacccatgcctggcccttctgctgtatttgcaatgaagtcagcaagttcctgtgctattgagcaaggaaacttatctctgtgtgaaactgctttagatcaaggctactctgaaactaaggcctttgagatggctggaccctccaaaggtaaagaaagctagataccctccttggagttgcaagtattctttcaaggttggaagagggattttgaagaggtatctctccaagcaagaatgacttgtttttccataagggacatgagcattttactaggcttggaagagctgacatgatgagcattattgtatgtttgtatatacatttgtgatagagggctagagtttgacctagagagagtttaaggaagtgaaatatttaattcagaaccaaatgcttttgtaaaactttttggattttgtaaaagcattttcattctcttagaaattcaagtattttcaaggggagtcatttgagatatatttattttactaggagatcttatattctagggaaatgctttaaatggtcaggctccagtcggaatttttttaagaaaaaagtagtttttaatacattggttaggactcagaggaaatacggaaaaaacattgtagatggttaatttacagataaaatcccaagagccttttaaacaacaaggtacctaaaatagggtataattatactgcttaaaatacagttagtgcctattaatagctttttatttcctatgggaagatgcttttggtcttctggctgaagatgtaggcatacctctcactcatttcaatgttttcctgaggtggagccttcattggaaaggggaaagagggattctagggtttcatcagggaccaggaatgcattcctctgtcaggttccaatcaagagaagaccttttatgagatctgcctctgtatagatgttgtcagttaggaaactgaagccataggtcaggcagacatcagctcagcctgtggcccattgggtgatttcctgtattttaaaactgacagtagcctgatcaaagtgatacaatcaatttcaaaacaatcttccagagaccacttgaaggttcatagtttttacaataccctgagacttttcaggtgttggagcctctaaaatatgagatataaacagaaactaatacaagttgttctctggaggtttctatgaggttcttagaaaaatttggttttaaaatcatttgaggacaggaatgtctatagcaagtttactcctattgcgaatcatgtatgctggctttagttgtaacaaacgattttattctaagtaaggccaggtgctactataaaatcatatattcctgttgaagttcttttgaagtcctatctctatttattatatttgaaagttgtcagccaccagtcatccagaatttccttcctgaatctccatgctcatatgcaatgtctacatcaaggtcttcttaatgactattattctcagggtttagttttctaccttctgcctactattttggtctgacatttttgtagccttctgttattattggaaatagtctcttacataagctgatttcgagaactttcaaaatctcacatagctaatggaagttgctttctgctttcttatgactgtttttataaataaactgtttcataaataatgtatactggaaaattgtcatcactcttgtaaacatttgccaaatccaactgtaattagtaccagaacttagaaggaaagtcacaaagcatgccttttaccagaatattgctttgccttttcttatatggaaaatcactgatgtcatatcatttattatcctcacagcagctggcattcattccctgaaatcgtcgtctcctgataaacaataatttagagatatgttcacttgtaaataaaaaggttagaatctaaggacaaagaatgatccaaaaatactaaggaaaaagaacaattttcaattttcagaaatgaattatctgtacatatgaatagaggaaaatactgagtgctaatgttacagggccacaatctcatatccacaattccaaaatctccaaacctctgaaaactgaaatatttttcataaattaggcgtaaattctatgccctgaacaaatgtaaagctatttatgtactttgcttaatgtaatcattcatatactttgctacaaaaatattaatatatttcattactg

SEQ ID NO: 375343 - DNA, 4409 bp, Homo sapiens
  misc_feature (4324)..(4324): n is a, c, g, or t
caatgttcccgagcctgatggacatatcatatcaccactgttggcaggattttatatgttttggaccatgatcattttgttacaggtcttgattcctatttctctctatgtttccatcgaaattgtgaagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccagagcaggtcatggtggactttgctgctttgggaccattaacatttcaactcctacacatactgccctttgactcagtaagaaaaagaatgtctgttgtggtccgacaccctctttccaatcaagttgtggtgtatacgaaaggcgctgattctgtgatcatggagttactgtcggtggcttccccagatggagcaagtctggagaaacaacagatgatagtaagggagaaaacccagaagcacttggatgactatgccaaacaaggccttcgtactttatgtatagcaaagaaggtcatgagtgacactgaatatgcagagtggctgaggaatcattttttagctgaaaccagcattgacaacagggaagaattactacttgaatctgccatgaggttggagaacaaacttacattacttggtgctactggcattgaagaccgtctgcaggagggagtccctgaatctatagaagctcttcacaaagcgggcatcaagatctggatgctgacaggggacaagcaggagacagctgtcaacatagcttatgcatgcaaactactggagccagatgacaagctttttatcctcaatacccaaagtaaagatgcctgtgggatgctgatgagcacaattttgaaagaacttcagaagaaaactcaagccctgccagagcaagtgtcattaagtgaagatttacttcagcctcctgtcccccgggactcagggttacgagctggactcattatcactgggaagaccctggagtttgccctgcaagaaagtctgcaaaagcagttcctggaactgacatcttggtgtcaagctgtggtctgctgccgagccacaccgctgcagaaaagtgaagtggtgaaattggtccgcagccatctccaggtgatgacccttgctattggtgatggtgccaatgatgttagcatgatacaagtggcagacattgggataggggtctcaggtcaagaaggcatgcaggctgtgatggccagtgactttgccgtttctcagttcaaacatctcagcaagctccttcttgtccatggacactggtgttatacacggctttccaacatgattctctattttttctataagaatgtggcctatgtgaacctccttttctggtaccagttcttttgtggattttcaggaacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggcatacttaccccataccttctggatcaccttattggatgctttttatcaaagcctggtctgcttctttgtgccttattttacctaccagggctcagatactgacatctttgcatttggaaaccccctgaacacagccgctctgttcatcgttctcctccatctggtcattgaaagcaagagtttgacttggattcacttgctggtcatcattggtagcatcttgtcttattttttatttgccatagtttttggagccatgtgtgtaacttgcaacccaccatccaacccttactggattatgcaggagcacatgctggatccagtattctacttagtttgtatcctcacgacgtccattgctcttctgcccaggtttgtatacagagttcttcagggatccctgtttccatctccaattctgagagctaagcactttgacagactaactccagaggagaggactaaagctctcaagaagtggagaggggctggaaagatgaatcaagtgacatcaaagtatgctaaccaatcagctggcaagtcaggaagaagacccatgcctggcccttctgctgtatttgcaatgaagtcagcaagttcctgtgctattgagcaaggaaacttatctctgtgtgaaactgctttagatcaaggctactctgaaactaaggcctttgagatggctggaccctccaaaggtaaagaaagctagataccctccttggagttgcaagtattctttcaaggttggaagagggattttgaagaggtatctctccaagcaagaatgacttgtttttccataagggacatgagcattttactaggcttggaagagctgacatgatgagcattattgtatgtttgtatatacatttgtgatagagggctagagtttgacctagagagagtttaaggaagtgaaatatttaattcagaaccaaatgcttttgtaaaactttttggattttgtaaaagcattttcattctcttagaaattcaagtattttcaaggggagtcatttgagatatatttattttactaggagatcttatattctagggaaatgctttaaatggtcaggctccagtcggaatttttttaagaaaaaagtagtttttaatacattggttaggactcagaggaaatacggaaaaaacattgtagatggttaatttacagataaaatcccaagagccttttaaacaacaaggtacctaaaatagggtataattatactgcttaaaatacagttagtgcctattaatagctttttatttcctatgggaagatgcttttggtcttctggctgaagatgtaggcatacctctcactcatttcaatgttttcctgaggtggagccttcattggaaaggggaaagagggattctagggtttcatcagggaccaggaatgcattcctctgtcaggttccaatcaagagaagaccttttatgagatctgcctctgtatagatgttgtcagttaggaaactgaagccataggtcaggcagacatcagctcagcctgtggcccattgggtgatttcctgtattttaaaactgacagtagcctgatcaaagtgatacaatcaatttcaaaacaatcttccagagaccacttgaaggttcatagtttttacaataccctgagacttttcaggtgttggagcctctaaaatatgagatataaacagaaactaatacaagttgttctctggaggtttctatgaggttcttagaaaaatttggttttaaaatcatttgaggacaggaatgtctatagcaagtttactcctattgcgaatcatgtatgctggctttagttgtaacaaacgattttattctaagtaaggccaggtgctactataaaatcatatattcctgttgaagttcttttgaagtcctatctctatttattatatttgaaagttgtcagccaccagtcatccagaatttccttcctgaatctccatgctcatatgcaatgtctacatcaaggtcttcttaatgactattattctcagggtttagttttctaccttctgcctactattttggtctgacatttttgtagccttctgttattattggaaatagtctcttacataagctgatttcgagaactttcaaaatctcacatagctaatggaagttgctttctgctttcttatgactgtttttataaataaactgtttcataaataatgtaaaaaaaaaaaaaaaggaaaaaaaaaattttgggggggatgggcctggaaaggtttttaaacaccattgtgtgtgggcggggggccccagatgggtacacgtaacacggggcacaaaagggtcccagagggagacccggggcgagaacaaacgcctgggattcccaccaattaaagagcggccgggganaccggagcgctttggacaactcaagagagaatcaagaggaccaaggggactttcacaagggggtcacaggaagtcgaattaaatg

SEQ ID NO: 375344 - DNA, 468 bp, Homo sapiens
gacacccaatacaatctcttgttaggaaaaaagaagaatgaatggcacgaggcagtcaatggctcgtagaaagtatgaaatcttgatggggagtcactgcaaaggccgcataccctgagatgaaaaaatagtcttaattatatccaaaatcttatttctggcaagaattgttctctgaaaaccctggtttggccctcttggaagtatgtctttatttgatacccattattatctaattatgtaggaaaaatgtctggcttccttgggagctgagcaaattttgtccctttatgcttgtagctcttttttatttgtttctagctagtttcttcccctagtaactccatacaaagctgttttctagattgtgccttgaggtttgactatttcattgctttctcaccccatctctctctttctcaaagtaataacaaggtaattgaggctatctgaaacaatagggttggg

SEQ ID NO: 375345 - DNA, 7334 bp, Homo sapiens
gcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtctccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactatacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcaaagaaggggatcaacctgaaagagtccaaccaatcgcatcatctaccttgatccattccgacctgacatccgtttatggcaccgtggtaatgaacaggactgttttattcttggggactggagatggccagttacttaaggttattcttggtgagaatttgacttcaaattgtccagaggttatctatgaaattaaagaagagacacctgttttctacaaactcgttcctgatcctgtgaagaatatctacatttatctaacagctgggaaagaggtgaggagaattcgtgttgcaaactgcaataaacataaatcctgttcggagtgtttaacagccacagaccctcactgcggttggtgccattcgctacaaaggtgcacttttcaaggagattgtgtacattcagagaacttagaaaactggctggatatttcgtctggagcaaaaaagtgccctaaaattcagataattcgaagcagtaaagaaaagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaagatgtttcagttgtcaacgtgatgttctccttcggttcttggaatttatcagacagattcaactttaccaactgctcatcattaaaagaatgcccagcatgcgtagaaactggctgcgcgtggtgtaaaagtgcaagaaggtgtatccaccccttcacagcttgcgacccttctgattatgagagaaaccaggaacagtgtccagtggctgtcgagaagacatcaggaggaggaagacccaaggagaacaaggggaacagaaccaaccaggctttacaggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcagtggtggtcaaaatataaccatgatgggcagaaattttgatgtaattgacaacttaatcatttcacatgaattaaaaggaaacataaatgtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaaaaagaaaatgacaacttcaacatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtcaagctgggaaacctggagctctacgtcgagcaggagtcagttccttccacatggtattttctgattgtgctccctgtcttgctagtgattgtcatttttgcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagtcaggtggcttcacccacatcttcactgaagatatgcataacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaagaaacatgaaaatgaatttaatgaagaagtggccttgacagaaatttacaaatacatcgtaaaatattttgatgagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacatttcatcgaattgctgttcacactggagtattatatataaatatatatatttgaggcccaaggcctggaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattt

SEQ ID NO: 375346 - DNA, 520 bp, Homo sapiens
tgccttcttttaaatgcttgcatgccacatcacagagggaaattctaggatgtgaacattgtcctaaaacgcaggaattaagtcagttttctgtgttgctagatgcccagcatgcgtagaaactggctgcgcgtggtgtaaaagtgcaagaaggtgtatccaccccttcacagcttgcgacccttctgattatgagagaaaccaggaacagtgtccagtggctgtcgagaagacatcaggaggaggaagacccaaggagaacaaggggaacagaaccaaccaggctttacaggtcagaccctatttttgtgtggttgaggggaaaacctgtctttgaatgaccatgaccacaactcatactactttgggttccttaaaaaaattctctattttactttctaccaaaattcccttttgtgtctttggttttttaaccaagtttcacttaattagcgcaatacatcaatggctggacactcacataaaataaattaaaactctgtaattatgaaaaatgatg

SEQ ID NO: 375347 - DNA, 4110 bp, Homo sapiens
tgtgacagtctcactctgtcacccaggctggagtgcagtggcgcaatcttggctcactgcaacctccgcctcccagattcaagtgattaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaaggtatcattagaaagcagaaataagcttatatttggttactttacgtcatttcagaatctctcaacaagtctttcttttagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatgagtaagtagtggccctattaaatggggtcagcttatgcttgattgtaatttgctaaaaatgaaagctaagcttgttaaattgcctagattctgtattcaatcgttatatgaaattatgacatatttctaacttaagcgactatttcaataaaccattctcctttatgattaattctccttaatctgggtttttttctttggaaattcaaacagacacattcatcagatgctttgtttccaaacaaatgttaactcccccttccctgattcccccccaatcatgctgggacaggctatccatgtcaatggtgagaatagctcaccaattccatttgctacttgaagatgaagtgaagctctaaggtagggtagaggcaatgagttcttaaacatgataagcatccctcgttccaggggtcaggggagagaagggaagcacgaggagggactacactgcccagatgggagggaagggaaggatctgtctctgaccaggatgtccctgcctgctgcatttaaggagaaatacttgcctgcatgttggctgcccaggaatgcttgctgtgcttggaatggctgtgacataatgcataaagcagggcctaggaagcctggccccatatttgtaagcaaatagttggtatttcttgcgagcttctattttaagccaaggtattgttgatcctgtgataaggacttagcaaaacaacttgcaaagtgagtatgtaaatgatggaagaaaatgttggcatctgtttcatacagattttaccactcacagcatcaggtatgcaaaaaacagaattgtaacgctaaaaccacaatatctaaaataactgttctaattgtcaacagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacatttcatcgaattgctgttcacactggagtattatatataaatatatatatttgaggcccaaggcctggaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattt

SEQ ID NO: 375348 - DNA, 2098 bp, Homo sapiens
gcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtctccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactatacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcaaagaaggggatcaacctgaaagagtccaaccaatcgcatcatctaccttgatccattccgacctgacatccgtttatggcaccgtggtaatgaacaggactgttttattcttggggactggagatggccagttacttaaggttattcttggtgagaatttgacttcaaattgtccagaggttatctatgaaattaaagaagagacacctgttttctacaaactcgttcctgatcctgtgaagaatatctacatttatctaacagctgggaaagaggtgaggagaattcgtgttgcaaactgcaataaacataaatcctgttcggagtgtttaacagccacagaccctcactgcggttggtgccattcgctacaaaggtatctcctgaattctttctcaccaactcgcatttttgaaaaagtgtcatgcggcagaacacttgttgccctactttaacgatccattccagtgacctgagggaactgatctcttcctcgactaaaatcttgttgtgcaatcctaatgaattctcgaaggtgtttccagcggcgtccgtgctatgcaatcactggacccgggagctccccagtctcggggcgggaggggcaggtgtgcagccttcaggagaacgggagagagcaggcaggtttggcttttactttctccagagttcgccaagactcaagagagaggcaaaagggccccccctccgagaagataaaagaatagagatgtctgaaaatttttcagctgaatccccatcatgtatgtcatgtattctgttcgc

SEQ ID NO: 375349 - DNA, 319 bp, Homo sapiens
atttaccactttattcaagttttagttatccataaatttgtgaaagtaaagtggtggcattttaaaactctctaaaaaggaacaaaatgctctttttcagagcttcaaatgggcacacgacagaaagaacttctggacatcgacagttcctccgtgattcttgaagatggaatcaccaagctaaacaccattggccactatgaggtaagagcaagacttgaccccgtgtctccttcctcatccccaatcctagtcccatggacattcttttaaaacatccaggactcccacccatttcctggaatgacttgcagatcga

SEQ ID NO: 375350 - DNA, 315 bp, Homo sapiens
tacaccttcaaacaaagatttaccactttattcaagttttagttatccataaatttgtgaaagtaaagtggtggcattttaaaactctctaaaaaggaacaaaatgctctttttcagagcttcaaatgggcacacgacagaaagaacttctggacatcgacagttcctccgtgattcttgaagatggaatcaccaagctaaacaccattggccactatgaggtaagagcaagacttgaccccgtgtctccttcctcatccccaatcctagtcccatggacattcttttaaaacatccaggactcccacccatttc

SEQ ID NO: 375351 - DNA, 261 bp, Homo sapiens
aaagaaggggatcaacctgaaagagtccaaccaatcgcatcatctaccttgatccattccgacctgacatccgtttatggcaccgtggtaatgaacaggactgttttattcttggggactggagatggccagttacttaaggttggttttctgtgccttcttcaaatgtctattttaatggtgatattttgtactttaaaaaaacatttttttaatgcttctgggttatacatgagaccaaaccaagaacttcatgaactc

SEQ ID NO: 375352 - DNA, 823 bp, Homo sapiens
gcgggactcagagtcaccaccctggggctgaaccagaaagaaggggatcaacctgaaagagtccaaccaatcgcatcatctaccttgatccattccgacctgacatccgtttatggcaccgtggtaatgaacaggactgttttattcttggggactggagatggccagttacttaaggttattcttggtgagaatttgacttcaaattgtccagaggttatctatgaaattaaagaagagacacctgttttctacaaactcgttcctgatcctgtgaagaatatctacatttatctaacagctgggaaagaggtgaggagaattcgtgttgcaaactgcaataaacataaatcctgttcggagtgtttaacagccacagaccctcactgcggttggtgccattcgctacaaaggtatctcctgaattctttctcaccaactcgcatttttgaaaaagtgtcatgcggcagaacacttgttgccctactttaacgatccattccagtgacctgagggaactgatctcttcctcgactaaaatcttgttgtgcaatcctaatgaattctcgaaggtgtttccagcggcgtccgtgctatgcaatcactggacccgggagctccccagtctcggggcgggaggggcaggtgtgcagccttcaggagaacgggagagagcaggcaggtttggcttttactttctccagagttcgccaagactcaagagagaggcaaaagggccccccctccgagaagataaaagaatagagatgtctgaaaatttttcagctgaatccccatcatgtatgtcatgtattctgttcgc

SEQ ID NO: 375353 - DNA, 8543 bp, Homo sapiens
gcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtctccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactatacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcaaagaaggggatcaacctgaaagagtccaaccaatcgcatcatctaccttgatccattccgacctgacatccgtttatggcaccgtggtaatgaacaggactgttttattcttggggactggagatggccagttacttaaggttattcttggtgagaatttgacttcaaattgtccagaggttatctatgaaattaaagaagagacacctgttttctacaaactcgttcctgatcctgtgaagaatatctacatttatctaacagctgggaaagaggtgaggagaattcgtgttgcaaactgcaataaacataaatcctgttcggagtgtttaacagccacagaccctcactgcggttggtgccattcgctacaaaggtgcacttttcaaggagattgtgtacattcagagaacttagaaaactggctggatatttcgtctggagcaaaaaagtgccctaaaattcagataattcgaagcagtaaagaaaagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaagatgtttcagttgtcaacgtgatgttctccttcggttcttggaatttatcagacagattcaactttaccaactgctcatcattaaaagaatgcccagcatgcgtagaaactggctgcgcgtggtgtaaaagtgcaagaaggtgtatccaccccttcacagcttgcgacccttctgattatgagagaaaccaggaacagtgtccagtggctgtcgagaagacatcaggaggaggaagacccaaggagaacaaggggaacagaaccaaccaggctttacaggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcagtggtggtcaaaatataaccatgatgggcagaaattttgatgtaattgacaacttaatcatttcacatgaattaaaaggaaacataaatgtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaaaaagaaaatgacaacttcaacatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtcaagctgggaaacctggagctctacgtcgagcaggagtcagttccttccacatggtattttctgattgtgctccctgtcttgctagtgattgtcatttttgcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagtcaggtggcttcacccacatcttcactgaagatatgcataacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaaggtatcattagaaagcagaaataagcttatatttggttactttacgtcatttcagaatctctcaacaagtctttcttttagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatgagtaagtagtggccctattaaatggggtcagcttatgcttgattgtaatttgctaaaaatgaaagctaagcttgttaaattgcctagattctgtattcaatcgttatatgaaattatgacatatttctaacttaagcgactatttcaataaaccattctcctttatgattaattctccttaatctgggtttttttctttggaaattcaaacagacacattcatcagatgctttgtttccaaacaaatgttaactcccccttccctgattcccccccaatcatgctgggacaggctatccatgtcaatggtgagaatagctcaccaattccatttgctacttgaagatgaagtgaagctctaaggtagggtagaggcaatgagttcttaaacatgataagcatccctcgttccaggggtcaggggagagaagggaagcacgaggagggactacactgcccagatgggagggaagggaaggatctgtctctgaccaggatgtccctgcctgctgcatttaaggagaaatacttgcctgcatgttggctgcccaggaatgcttgctgtgcttggaatggctgtgacataatgcataaagcagggcctaggaagcctggccccatatttgtaagcaaatagttggtatttcttgcgagcttctattttaagccaaggtattgttgatcctgtgataaggacttagcaaaacaacttgcaaagtgagtatgtaaatgatggaagaaaatgttggcatctgtttcatacagattttaccactcacagcatcaggtatgcaaaaaacagaattgtaacgctaaaaccacaatatctaaaataactgttctaattgtcaacagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacatttcatcgaattgctgttcacactggagtattatatataaatatatatatttgaggcccaaggcctggaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattt

SEQ ID NO: 375354 - DNA, 4551 bp, Homo sapiens
gcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtctccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactatacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcaaagaaggggatcaacctgaaagagtccaaccaatcgcatcatctaccttgatccattccgacctgacatccgtttatggcaccgtggtaatgaacaggactgttttattcttggggactggagatggccagttacttaaggttattcttggtgagaatttgacttcaaattgtccagaggttatctatgaaattaaagaagagacacctgttttctacaaactcgttcctgatcctgtgaagaatatctacatttatctaacagctgggaaagaggtgaggagaattcgtgttgcaaactgcaataaacataaatcctgttcggagtgtttaacagccacagaccctcactgcggttggtgccattcgctacaaaggtgcacttttcaaggagattgtgtacattcagagaacttagaaaactggctggatatttcgtctggagcaaaaaagtgccctaaaattcagataattcgaagcagtaaagaaaagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaagatgtttcagttgtcaacgtgatgttctccttcggttcttggaatttatcagacagattcaactttaccaactgctcatcattaaaagaatgcccagcatgcgtagaaactggctgcgcgtggtgtaaaagtgcaagaaggtgtatccaccccttcacagcttgcgacccttctgattatgagagaaaccaggaacagtgtccagtggctgtcgagaagacatcaggaggaggaagacccaaggagaacaaggggaacagaaccaaccaggctttacaggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcagtggtggtcaaaatataaccatgatgggcagaaattttgatgtaattgacaacttaatcatttcacatgaattaaaaggaaacataaatgtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaaaaagaaaatgacaacttcaacatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtcaagctgggaaacctggagctctacgtcgagcaggagtcagttccttccacatggtattttctgattgtgctccctgtcttgctagtgattgtcatttttgcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagtcaggtggcttcacccacatcttcactgaagatatgcataacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttggtaaggcggtgcgggagctatgtggtcccaggccctgatgagtgtccctccctgcctgccctccctccctgtcccccctccctgcccccaccagcttccattcagtgacacttacacagccaggttgttcctggagggcatgtctaggggccaagagactgctttggtctctcatgggcatcctgattcttcgaaggaagcacggtccttcaaagatggcgtttgttgttgttgtctttaaatattacgtctgtaaatcagattgatgagattgcaggccctgagactgcacggaatcaccttgcatcatgaaatacagaaaggtgtcaacacagtgccctctgcgtgtgttgcatttcacattggcatttgatttgtttgttgtgatactgagcgtgtcattactgggtggcttccggattaagatttgctccgcctcccccaggggcaacaaatttgcattgaatcattttcggccttacggggatctctcgaaggaaactattcctcgaccaactctacaggct

SEQ ID NO: 375355 - DNA, 5215 bp, Homo sapiens
  misc_feature (3115)..(3115): n is a, c, g, or t
  misc_feature (3117)..(3117): n is a, c, g, or t
tagcggcttctgcggctccaagccagcgggtcctgtgaaggcgagcagacgcggagaaaggacgcgggagtgagagagggtgagtcagccactgtctaaacgataacgggaggcggctctgcggggtagggttgaattcagtaaatgggctcgtgctgctgtctcttcggagacgctgctatcttagcgtcagcgagggaaggttgaggaggagccagagccgggtcctgcagcgtttctcgccatcagcgcccgtcgccatctccaccatgcagtcccgggaagacgccccgcgctctcgccgcctagccagtccccgtggtgggaagcggcccaagaagattcacaaacccacagtttcggcctttttcacgggtccagaggaattaaaggacacggcccattctgcagccctgctggcacagctcaagtccttctacgatgcgcggctgctgtgtgatgtgaccatcgaggtggtgacgcctggcagcgggcctggcacgggtcgcctgttcccctgcaaccgcaatgtgctggccgcggcatgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaacgtggagcgcctgtacgcggcctccgacatgctacagctggaatatgtgcgggaagcctgtgcctccttcttagcccgacgtcttgacctgaccaactgcaccgccatcctcaagtttgcagatgcctttggccatcgcaagctgcgatcccaggcccagtcctatatagctcagaacttcaagcaactcagccacatgggttcaattcgggaggagactctagcagatctgaccctggcccagctgctggctgtcctgcgcttggatagtctggacgtggagagtgagcagacagtgtgccatgtggcagtgcagtggctggaggctgctcccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacaccccagagatccctttctctgctgtgatccatactcgggggacctttacaaagtgccgtcacctttgacctgtctggctcacactaggactgtcaccactctagctgtctgtatctctcctgaccatgacatctatctagctgctcagcccaggacagacctctgggtgtataaaccagctcagaatagttggcagcaacttgcagatcgcttgctgtgtcgtgagggcatggatgtggcatatctcaatggctatatctacattttgggggggcgagaccctattactggagttaagttgaaggaagtggaatgctacaatgttaagagaaaccagtgggcattggtggctccactgccccattcttttttatcctttgacctaatggtaattcgagactatctctatgctctcaacagtaagcgcatgttctgttatgatcctagccacaatatgtggctgaagtgcgtttctctgaagcgcaatgactttcaggaagcctgcgtcttcaatgaggagatctattgtatctgtgatatcccagtcatgaaggtctacaacccagttagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttcctcactgaagaagaagaaataccaagtgagtctagcactgaatgggacttaggtggattcagtgagccagactctgagtcaggaagttcaagttctctttctgatgatgatttttgggtgcgtgtagcgcctcagtgaaatgcacaggatcaacagggtttgttgtaactagattgaaacactaagttgtttttactgttttggaaaatatcttaaatatcctttttgttcctaaaggagaggaaaagttgattaacttctggtttggtttagaaaaagtaatgtttgaaatacgaaggtaatttaatgttacaaattttaacactcaaatcaaccttttaataattttctgtgctaagggtccagtatttatttgattatttagtatgtttatgtttcatgacactaatttagtcttttgatacattttacattctgtttactgccacaagcactgtggcaataacttttgaattttaatttttataatagaaaaatgattaggaattgctagatagtgttttgaaagcatatctttttcttcagaacaatgtagacttccaaaatggttaacctaaggggtctttacaaaatgtgttataagttaaacataatttgggaagttttacttttgttttcttctatgaagaaaaaaatgcaggctgggcgcggtggctcacgcctgtaatcctagcactttgggaggccgaggcaggtggatcacctgaggtcagttcaagaccagcctggccaacatggtgaaaccccgtctctactaaaaatacaaaaattagctgggcgtggtggcatgcgcctgtaatcccagctacccaggaggctgaggcaggagaattgctgaaacccgggagtcagaggctgcagagagccgagactgggccactgcactccagcctggatgacagagtgagactccgtctcaaaaaaaaaaaaaaaaaaangnaaaaaaaaaaaagaaaaaaaaccatatgtgtattagggtgactgagtggtgacttcatttataataatacagagaatagctataagctcattgacagtaaaaacaacaaaccaggattctactgtttgaaaagaagtttcgttttaattttggaatttagaatgtgtatttgcaaagtcaccaattttcatctaaaaggttatattctagttgtgtcaccaaatcatcaaaaaaccttaaaaaagaagtaacttgctttgtaggtttgtattgttgatctaaacctgatacatgcttcatttaatcaggaataatccttttttttctgctggacatgtataaatttcactggattgtataaatttttatctattgccttaaacatttacatgattctcaatatgttttagctgtacagttttggtgttcatcttagaggattcttcagcagaagtgatatttctttactgttttgtgaggtaatactgattttgaaaatatatataagctaaaaacagtatttcgttgatatcagtagtcattgtgttaactataaagtcaagtgccagcaaagaactttaaaactgtaaagctgtgtatagaactgttttgtgtagcatggaaatattctgtcagctttttaaagtcactaaatgttcttgattatcagcttgaaggtatttttgtattacaagttgacagttgctgggtgtagtggctcatgcctgtaatcctagcaactcggggctgaggtgggaggattgcttcagcccaggagtttgagaccagcctgggcaacatagcaaaaccccatctctacaaaaataaaaaatatgtctgggcatggtggcccaagtctgagtcccagttacttgggaggatcacttgaatgtaggatcacttgagtctaggagttcggggctgcagctatcatctgcagctataatcatagctcactgcagctatgatcatgtctcagcactccagctttggcaacagaacgagatcccatctcttagaaaaacaaagttgatagttaaagaacataagtggatgatggcatttgaggccactagtgaaagtatgttttctctaaaatatttctctaatagtgatataaatggctattttattatgatgtttgtatgtgttttgtatttctctgtaaaccatgctccagtctttgtttttctgttaccataatgtaagagaaggtcctggaacagagactaaatcccacgaaactgacattgttaaacacactaaaacagaagtacttacctcttgaagatttaatatataatggttgacatgatacatgtacatgatgaatgaccagatgcttatggtctacattttcctttatcctgttagtattaccttccttaatctttgttcattaacatgctaattcctcttcagtgtttattttctagtgacagaatgctaacatttcttacaccctggcagaagggagagaaatgtgttttggggtgggtaactaaatttttgagtgaaatatcataagatgagaatggaaagagggagacacaaagagttataacaaaaaaacaatggtttttttagccatttgactggctctttaaatagtctacaagacattcacgtttaacatcacttttagtgaaataaaatgtgccatactagtatgtgcttcaaaagggcaaatgtgctttagtgccctaaggctaaattttggtcatttgacatcagagatgttgtaagtattgcacttaatacgcacctatttctcaatagtgttattttttggctagcattttctttaccactatcttgttgatagctttttgttctctaaggttgaaacatgacagtgcttatctcaaacagattacccatctgcagaactaaggaaagcaatttatgtatgaaagaaattcttgaattcgtcattctcaacctttgaattaaagcttagactaaatagtaatatatcgtgggaaggattttggttttgtgatatttctgtgaattaaggaatagatgttaaccattattttgtagaaaagtgatttgtatgtggttaattataaataaaactggtaccagaaactta

SEQ ID NO: 375356 - DNA, 1767 bp, Homo sapiens
tagcggcttctgcggctccaagccagcgggtcctgtgaaggcgagcagacgcggagaaaggacgcgggagtgagagaggctgtacagttttggtgttcatcttagaggattcttcagcagaagtgatatttctttactgttttgtgaggtaatactgattttgaaaatatatataagctaaaaacagtatttcgttgatatcagtagtcattgtgttaactataaagtcaagtgccagcaaagaactttaaaactgtaaagctgtgtatagaactgttttgtgtagcatggaaatattctgtcagctttttaaagtcactaaatgttcttgattatcagcttgaaggtatttttgtattacaagttgacagttgctgggtgtagtggctcatgcctgtaatcctagcaactcggggctgaggtgggaggattgcttcagcccaggagtttgagaccagcctgggcaacatagcaaaaccccatctctacaaaaataaaaaatatgtctgggcatggtggcccaagtctgagtcccagttacttgggaggatcacttgaatgtaggatcacttgagtctaggagttcggggctgcagctatcatctgcagctataatcatagctcactgcagctatgatcatgtctcagcactccagctttggcaacagaacgagatcccatctcttagaaaaacaaagttgatagttaaagaacataagtggatgatggcatttgaggccactagtgaaagtatgttttctctaaaatatttctctaatagtgatataaatggctattttattatgatgtttgtatgtgttttgtatttctctgtaaaccatgctccagtctttgtttttctgttaccataatgtaagagaaggtcctggaacagagactaaatcccacgaaactgacattgttaaacacactaaaacagaagtacttacctcttgaagatttaatatataatggttgacatgatacatgtacatgatgaatgaccagatgcttatggtctacattttcctttatcctgttagtattaccttccttaatctttgttcattaacatgctaattcctcttcagtgtttattttctagtgacagaatgctaacatttcttacaccctggcagaagggagagaaatgtgttttggggtgggtaactaaatttttgagtgaaatatcataagatgagaatggaaagagggagacacaaagagttataacaaaaaaacaatggtttttttagccatttgactggctctttaaatagtctacaagacattcacgtttaacatcacttttagtgaaataaaatgtgccatactagtatgtgcttcaaaagggcaaatgtgctttagtgccctaaggctaaattttggtcatttgacatcagagatgttgtaagtattgcacttaatacgcacctatttctcaatagtgttattttttggctagcattttctttaccactatcttgttgatagctttttgttctctaaggttgaaacatgacagtgcttatctcaaacagattacccatctgcagaactaaggaaagcaatttatgtatgaaagaaattcttgaattcgtcattctcaacctttgaattaaagcttagactaaatagtaatatatcgtgggaaggattttggttttgtgatatttctgtgaattaaggaatagatgttaaccattattttgtagaaaagtgatttgtatgtggttaattataaataaaactggtaccagaaactta

SEQ ID NO: 375357 - DNA, 5304 bp, Homo sapiens
  misc_feature (3115)..(3115): n is a, c, g, or t
  misc_feature (3117)..(3117): n is a, c, g, or t
tagcggcttctgcggctccaagccagcgggtcctgtgaaggcgagcagacgcggagaaaggacgcgggagtgagagagggtgagtcagccactgtctaaacgataacgggaggcggctctgcggggtagggttgaattcagtaaatgggctcgtgctgctgtctcttcggagacgctgctatcttagcgtcagcgagggaaggttgaggaggagccagagccgggtcctgcagcgtttctcgccatcagcgcccgtcgccatctccaccatgcagtcccgggaagacgccccgcgctctcgccgcctagccagtccccgtggtgggaagcggcccaagaagattcacaaacccacagtttcggcctttttcacgggtccagaggaattaaaggacacggcccattctgcagccctgctggcacagctcaagtccttctacgatgcgcggctgctgtgtgatgtgaccatcgaggtggtgacgcctggcagcgggcctggcacgggtcgcctgttcccctgcaaccgcaatgtgctggccgcggcatgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaacgtggagcgcctgtacgcggcctccgacatgctacagctggaatatgtgcgggaagcctgtgcctccttcttagcccgacgtcttgacctgaccaactgcaccgccatcctcaagtttgcagatgcctttggccatcgcaagctgcgatcccaggcccagtcctatatagctcagaacttcaagcaactcagccacatgggttcaattcgggaggagactctagcagatctgaccctggcccagctgctggctgtcctgcgcttggatagtctggacgtggagagtgagcagacagtgtgccatgtggcagtgcagtggctggaggctgctcccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacaccccagagatccctttctctgctgtgatccatactcgggggacctttacaaagtgccgtcacctttgacctgtctggctcacactaggactgtcaccactctagctgtctgtatctctcctgaccatgacatctatctagctgctcagcccaggacagacctctgggtgtataaaccagctcagaatagttggcagcaacttgcagatcgcttgctgtgtcgtgagggcatggatgtggcatatctcaatggctatatctacattttgggggggcgagaccctattactggagttaagttgaaggaagtggaatgctacaatgttaagagaaaccagtgggcattggtggctccactgccccattcttttttatcctttgacctaatggtaattcgagactatctctatgctctcaacagtaagcgcatgttctgttatgatcctagccacaatatgtggctgaagtgcgtttctctgaagcgcaatgactttcaggaagcctgcgtcttcaatgaggagatctattgtatctgtgatatcccagtcatgaaggtctacaacccagttagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttcctcactgaagaagaagaaataccaagtgagtctagcactgaatgggacttaggtggattcagtgagccagactctgagtcaggaagttcaagttctctttctgatgatgatttttgggtgcgtgtagcgcctcagtgaaatgcacaggatcaacagggtttgttgtaactagattgaaacactaagttgtttttactgttttggaaaatatcttaaatatcctttttgttcctaaaggagaggaaaagttgattaacttctggtttggtttagaaaaagtaatgtttgaaatacgaaggtaatttaatgttacaaattttaacactcaaatcaaccttttaataattttctgtgctaagggtccagtatttatttgattatttagtatgtttatgtttcatgacactaatttagtcttttgatacattttacattctgtttactgccacaagcactgtggcaataacttttgaattttaatttttataatagaaaaatgattaggaattgctagatagtgttttgaaagcatatctttttcttcagaacaatgtagacttccaaaatggttaacctaaggggtctttacaaaatgtgttataagttaaacataatttgggaagttttacttttgttttcttctatgaagaaaaaaatgcaggctgggcgcggtggctcacgcctgtaatcctagcactttgggaggccgaggcaggtggatcacctgaggtcagttcaagaccagcctggccaacatggtgaaaccccgtctctactaaaaatacaaaaattagctgggcgtggtggcatgcgcctgtaatcccagctacccaggaggctgaggcaggagaattgctgaaacccgggagtcagaggctgcagagagccgagactgggccactgcactccagcctggatgacagagtgagactccgtctcaaaaaaaaaaaaaaaaaaangnaaaaaaaaaaaagaaaaaaaaccatatgtgtattagggtgactgagtggtgacttcatttataataatacagagaatagctataagctcattgacagtaaaaacaacaaaccaggattctactgtttgaaaagaagtttcgttttaattttggaatttagaatgtgtatttgcaaagtcaccaattttcatctaaaaggttatattctagttgtgtcaccaaatcatcaaaaaaccttaaaaaagaagtaacttgctttgtaggtttgtattgttgatctaaacctgatacatgcttcatttaatcaggaataatccttttttttctgctggacatgtataaatttcactggattgtataaatttttatctattgccttaaacatttacatgattctcaatatgttttagctgtacagttttggtgttcatcttagaggattcttcagcagaagtgatatttctttactgttttgtgaggtaatactgattttgaaaatatatataagctaaaaacagtatttcgttgatatcagtagtcattgtgttaactataaagtcaagtgccagcaaagaactttaaaactgtaaagctgtgtatagaactgttttgtgtagcatggaaatattctgtcagctttttaaagtcactaaatgttcttgattatcagcttgaaggtatttttgtattacaagttgacagttgctgggtgtagtggctcatgcctgtaatcctagcaactcggggctgaggtgggaggattgcttcagcccaggagtttgagaccagcctgggcaacatagcaaaaccccatctctacaaaaataaaaaatatgtctgggcatggtggcccaagtctgagtcccagttacttgggaggatcacttgaatgtaggatcacttgagtctaggagttcggggctgcagctatcatctgcagctataatcatagctcactgcagctatgatcatgtctcagcactccagctttggcaacagaacgagatcccatctcttagaaaaacaaagttgatagttaaagaacataagtggatgatggcatttgaggccactagtgaaagtatgttttctctaaaatatttctctaatagtgatataaatggctattttattatgatgtttgtatgtgttttgtatttctctgtaaaccatgctccagtctttgtttttctgttaccataatgtaagagaaggtcctggaacagagactaaatcccacgaaactgacattgttaaacacactaaaacagaagtacttacctcttgaagatttaatatataatggttgacatgatacatgtacatgatgaatgaccagatgcttatggtctacattttcctttatcctgttagtattaccttccttaatctttgttcattaacatgctaattcctcttcagtgtttattttctagtgacagaatgctaacatttcttacaccctggcagaagggagagaaatgtgttttggggtgggtaactaaatttttgagtgaaatatcataagatgagaatggaaagagggagacacaaagagttataacaaaaaaacaatggtttttttagccatttgactggctctttaaatagtctacaagacattcacgtttaacatcacttttagtgaaataaaatgtgccatactagtatgtgcttcaaaagggcaaatgtgctttagtgccctaaggctaaattttggtcatttgacatcagagatgttgtaagtattgcacttaatacgcacctatttctcaatagtgttattttttggctagcattttctttaccactatcttgttgatagctttttgttctctaaggttgaaacatgacagtgcttatctcaaacagattacccatctgcagaactaaggaaagcaatttatgtatgaaagaaattcttgaattcgtcattctcaacctttgaattaaagcttagactaaatagtaatatatcgtgggaaggattttggttttgtgatatttctgtgaattaaggaatagatgttaaccattattttgtagaaaagtgatttgtatgtggttaattataaataaaactggtaccagaaacttaaaaaaaactggcggcgttaacacgtgggaattggaaaccctgcgttccccaattattgcttggagcaattcctttcgcaaatggcttcg

SEQ ID NO: 375358 - DNA, 308 bp, Homo sapiens
tgactcacaactgctgtcttaggactgcttatttacatatatatgtattaagacactttggttaaaacaatttattaaatgtcttaaatttctggatatgtccctgaaaataccatgaactacttctaatactgataattatgaataaacgtagctgttgatcacctcaggttttcatacaaactgaactaaggtagggttttatcataggggactttttgtttcatttaatgaaattttgatgtgttgaactgctttcctggtgtcagagaaacatgagaccatcgctcaataatggaaataaaaag

SEQ ID NO: 375359 - DNA, 593 bp, Homo sapiens
gtggaagatgcagatacaggtttgattaaatgaagaatacatttttatagatgaatttgaaacactaaatcgataatccaaattccaaaggaggaagtagttcaactatctgtgccttttctatatttgaagagcttaacccatttaagcaaagattttacagaattttctttaaatgttctgttctcttaaatcctttgggggaaatggtagatgcaaaacctcttgtgacactcttactaaactcttgaatttggaattcaaggcccacttcctagtgtcagtttatcacttcaatcttctcaactattattctcctttttatcccatttagtttagtgatataaaatatttcctatcataaatataccttgttacatttctttgtctgtcttaacaaatcttgctgtcaaagtcctgtataaggtctgactcttgtgcatatatgaagatagttgagagcagtgggtagcattgtggttaagagagacccgtagcagaggggccagtttgggacattattgcaagagtctgggcaaaagataaggtcctgtgtctttgactttgtagtcaacagaaaatttaccaataag

SEQ ID NO: 375360 - DNA, 406 bp, Homo sapiens
aggctctttctttctgtgatctgagcccagttctgttcccagacttaactctgcctctggtcatagaaggaaccccaactttggtcctaaactgaaccctgaagtcctggccacaggaagggaccccattctggttctaggctgagccctatccctggcttcagtcttggttctaccccagccatagaaggaacccttttcctggtccccagaattatccctgacctcactcatgaaccaagccctgaccctgtccttgccacaggctgagctgccccatgccaagcaggtggtcttaactgcagtttagttcagggtggagaacagctaccaacgtccattgggctgacgtggtcagaattttcaccatagctattccaaataaaataaaacccaaagaaaaaaa

SEQ ID NO: 375361 - DNA, 450 bp, Homo sapiens
catatttgggccctactgtcaaaagagccacaaaattaccaaaggataagtacaaaagaagaattgattatcattatgaggtgttctaaaatttagttttaaacagtctgctcaggagtttaactgatgtggcctttaggggccggttaagatctggttaaggagaggctcagagaggagagaatgagagaaggtgagctaagccagccttgaaacatggttaattcacacaagtggaggtgaagctatggggcgttggaaatgctgagccagggggaggacctggaatggtgtgattccttcgtggagtcagtgaggaggctgatctatttaattgaggatttgggaggcaaggtggggtgcagtgggaggtaaaagtgagactgaagacataaggttgagcctgattatttctaagaagccaggcgaaggtgaaacatttgacataat

SEQ ID NO: 375362 - DNA, 128 bp, Homo sapiens
ggcatttaaattatgagattagacacttaaattactgactggaggaccttttatcacctagtagtgtttcaaaattaatgagacatgtcctaatttccattcaggggaagggaaatgattttcctcac

SEQ ID NO: 375363 - DNA, 236 bp, Homo sapiens
ttttttgggacggagtctcactctgtcgcccaggctggagtgcagtggcatgacccgcggtaaccagcgtgagctcgcccgccagaagaatatgaaaaagcagagcgactcggttaagggaaagcgccgagatgacgggctttctgctgccgcccgcaagcagagggactcggagatcatgtccccgtacatcgttagaagcttgaattcgagcagtagtagtagtaggcggccgc

SEQ ID NO: 375364 - DNA, 475 bp, Homo sapiens
gacagaacgaggggacgtaacggaggcaggcggtaaccagcgtgactcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375365 - DNA, 550 bp, Homo sapiens
  misc_feature (34)..(34): n is a, c, g, or t
tttaaacccctttactactactatgctgcgagangagacagaaggggacagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375366 - DNA, 553 bp, Homo sapiens
  misc_feature (1)..(1): n is a, c, g, or t
  misc_feature (13)..(13): n is a, c, g, or t
  misc_feature (26)..(26): n is a, c, g, or t
  misc_feature (41)..(41): n is a, c, g, or t
  misc_feature (63)..(63): n is a, c, g, or t
ncggtaaggcttngatattcgaaacncggcccgccttcgantacggcttgcggagaagaccgncagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375367 - DNA, 687 bp, Homo sapiens
  misc_feature (164)..(164): n is a, c, g, or t
cgtgtgtggaggctggagaaggggaggctgagaaggaggaggcgggggctcaggtaggcctctgagagccctgcagaactgctgctctgtgccctccccgccttcccatagcatgagggacgcgtggagactgagaggacctgaggacatgcatggaagagganagcagatgagagcgtcaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccaaaaaaaaagaaaaaagagtcgagagtttttgtattggtaatgattcttgtatgaaagagtatagggcggttttgtctgaaatagtctcccacatataagatgggggataaatgaggggggggcaaataatagtgtgggggacaacaccagagggagtggggcccccgtgtcaagggggcactcggagcggaagtgggg

SEQ ID NO: 375368 - DNA, 309 bp, Homo sapiens
  misc_feature (6)..(6): n is a, c, g, or t
  misc_feature (51)..(51): n is a, c, g, or t
attttnccataaataaaaatataactaaaacaaaattatgtatatggtatnctgatatgtcagatactttggatatggtatttacttttaaaaatacagatattctgttgttgtttttttaaattaaggaaggaatctgaaagctttatcaagcaggcaggtcgagcagctgagactcttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375369 - DNA, 560 bp, Homo sapiens
ggcccacagcagcacacctgggagtagagcagatgcaaggcagcgaggtggagacttgctgaggaaaggcatacgttaatgtatgtgtgaggttaacccaggaggttgaattccaaaatttccccttcccctttcttccttttactcaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcactaggacactgctgcctccgctgtgctgctgtgccaggcccagggaggtgccggggctggggccggccttggcacccaccatccttgtcccagggattaggcttaggtccaccagatggaaggca

SEQ ID NO: 375370 - DNA, 498 bp, Homo sapiens
gtattagtgggagtttttattttcaatcaagggtttatcaagatttatttacagggcacttctgggaatgacccttcctgggagtttatggtgttggttgagaatgaggactaatatatttaaatatttttgcacgggagaaagaactggcaaaagtcactatcaagaaggaagatctggagctaatagtgagtggtagtgcctaactagtgtatgcggaggggaggctattctgcttaatttgggttgtttcctgaaacaagcggagtcagtatatttggtggcacattaatgcctgggaacctatgtaacatgatttttttctgcagatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagtttta

SEQ ID NO: 375371 - DNA, 271 bp, Homo sapiens
  misc_feature (14)..(14): n is a, c, g, or t
  misc_feature (20)..(21): n is a, c, g, or t
  misc_feature (23)..(23): n is a, c, g, or t
  misc_feature (25)..(27): n is a, c, g, or t
  misc_feature (29)..(29): n is a, c, g, or t
ctctagtacaacanctcatnncnannncncgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaatgagatgttagaagggggatgagatgttggaaggagggatgagatgttggaaggtgatatgagatgttggaagggcaatgagatgttggaaggt

SEQ ID NO: 375372 - DNA, 539 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375373 - DNA, 807 bp, Homo sapiens
gtcggcgtcccccacttcttagaggaacaagtggcgttcagccacccgagattgagcaatcacaggtctgtgaggcccttagatgtccggggctgcacgcgcgctacactgactggctcagcgtgtgcctaccctaccccggcaggcgcgggtaacccattgaaccccattcgtgatggggatcggggattgccaattattccccatgaacgaggaattcccagtaagttccggtctttcgcccgcccaaaacccccgcagactcagggcaaagggaatgccacaggtcccagcaccgatggcattccctttgccctgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375374 - DNA, 959 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccttaaaaaaaaaaaaaaaaacttcgaaaaaagtttctttccccccaaggggctttggggcccgcgcccttggttggcctaaaggacgaacccaaaaagggtgccaatgttcccaagcattcgggaaaaagccccagccggattgttcgcccattcgtatttggcacacgcgcaaggagcgcataaggggggaacccgcaaggggttgcgcaaaccgggatatcaccagctcaagttgccgtaaagccgaaagtgtgaagggaatactcgcgcctgaaggaagttgaagaccctcagattctaacccggacctggagttcacggcaaccttgttcgcaaaaggtggcggtctggcaagtcttttgccttaagggggttcaggtgcccaacagggccgttgtacggcggggatggggccccag

SEQ ID NO: 375375 - DNA, 777 bp, Homo sapiens
  misc_feature (34)..(34): n is a, c, g, or t
tttaaacccctttactactactatgctgcgagangagacagaaggggacagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcaaaaaaaaaaaacaaaaaggggggggccacgcagaaaagcgacacgggggggcggacacacgcaaagagcgagccccacagaccgtgagaaacacagagggggggccacaacagagagagggcgcaacgg

SEQ ID NO: 375376 - DNA, 1475 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccttgagcgcctggtttgactggggacttggggggatggggttggaagaatgactgccctttccctcatagctgtgtaaccaaaggctctggttagagaatatgaagggccttagcttttagacctgttctacctcctcaccaaatataatggcagacccatgtgtgtctggaatggccttgaattgctctttccttaaaatagctagctcttcaggagagtatctaaggcccactccatcttacctgaaccagttggtaagggtaaccatgacatagagtgaggcaaggaagaagacgaagtggaaggcagaatagttgtaggaaagatgctggacttggactggaggagctggaggggtttcttggtcagctggcctcgcagccccacccctttgccctggagagaggaaatggctgctgggagcagagctgctgaaacacctcttcccctctcccccaactacctttgttaaggctcttgagggttcttatggcactccacagagatctaccacttcttatggttcctcacttggcactcacctttgtctgcctccactgtttcagggcagcagaaacacagtgagggcttctgcaaaacagaacgcaggttttggaatggtcttaaaagatgtgagggtgttaatctaggaaacttcccccgtgaaaagattggtctagtattaaaaagtggaggcacacctgggttcaaattctagctccagcatataagtggctgtgcagactttggtaagatgtttaatcttttgtgcctcgatttctccatttgtaaaatggagcaaatacctacctcacagggttgttgtgagggttaaattaaatgagattatgtaaaagtatctagcacagttgcctagcacattgtgggtactcaataaaaggtaacagcagctataatctgagcattctgggtag

SEQ ID NO: 375377 - DNA, 761 bp, Homo sapiens
  misc_feature (42)..(42): n is a, c, g, or t
  misc_feature (54)..(54): n is a, c, g, or t
agaaacagtgaatcccccgggcttgcaggaacgcggcccgcntcgacacggctncgagaagacgacagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccaaaaaaaaaaaaaaaaaaaaaaaaaaaaaaaaaaaaaaaaaaaaaaaaaaaaaaaaaaaaaaaaaaaaaaaaaagcaaaaaaaaaaaacaaaaaggggggggccacgcagaaaagcgacacgggggggcggacacacgcaaagagcgagccccacagaccgtgagaaacacagagggggggccacaacagagagagggcgcaacgg

SEQ ID NO: 375378 - DNA, 876 bp, Homo sapiens
  misc_feature (42)..(42): n is a, c, g, or t
  misc_feature (54)..(54): n is a, c, g, or t
  misc_feature (586)..(586): n is a, c, g, or t
  misc_feature (593)..(593): n is a, c, g, or t
  misc_feature (595)..(596): n is a, c, g, or t
  misc_feature (601)..(601): n is a, c, g, or t
  misc_feature (612)..(612): n is a, c, g, or t
  misc_feature (615)..(616): n is a, c, g, or t
  misc_feature (624)..(624): n is a, c, g, or t
  misc_feature (626)..(626): n is a, c, g, or t
agaaacagtgaatcccccgggcttgcaggaacgcggcccgcntcgacacggctncgagaagacgacagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccaaaaaaaaaaaaaaaaaaaaaaaaaaattgnggggggncnngcccngaaaagttttnaanncattgtgngnggggccaaggtaagggacgtgcgccaacgcgcccaaggagaccggcccagaacagcgcggttctcccccataaaaaaccgggggaccgggcgcttgcaccccgaagggtccgaggctcacggtctaaacgggccagaactgatatgccccccggggaccaccgcactcccacacatcgaccacagcgaccacacatacaaaccacctcgccccgaccacacgcgaccgaccactactacacacacaaacg

SEQ ID NO: 375379 - DNA, 1049 bp, Homo sapiens
  misc_feature (540)..(540): n is a, c, g, or t
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccnaaaaaaaaaaaaaaaaaaaaaaaaaaaaaaaaaaaaaaaaaaaaaaggaggaaccaaaaaaccaaataaaacctaaaaaaaatcaaataacaattaaactgaaaaacatttaacaaaaaaaaaaaaacttaggggggggccccgaccccaattaccccctatgggagggcatttccaattcacgggccggcgtttaaacaattaggaatggaaaaacccctgtttttaccaatttaacagccttaagggcaaatccccttttgcagttggggtgataacgaaaaaggcccgcccaatcggcctttacaaagagtggccacccataagggcgatgggaaaattaaagctttaattttggataaaaatcccgaaaatttggtgaaaacccctaaattttaaaccaatggcccaaatcggggaaatcctttaaacaaaaaaatcccccctaagggtaagttgtttccaatggaaaacgatcccttttaagaacctgcctcacgtaaaaggga

SEQ ID NO: 375380 - DNA, 1030 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccaaaaaaaaaaaaaaaaaaaaaaaaaaaaaaaaaaaaaaaaaaaaaaagcaaaaaaaaaaaacaaaaaaaaaaaaaaaaacaaaaaaaaaaacaaacaaaaaacaaaacaacacggggggcggcgccgccgcaacaacaccacccccggcgcgggagcgacggcgaccaccggcgccacaccactgttctgttacaaaagcgacggccgcacccacacgaggggcgactcttaatataatcaacaaacggcacgcgggtcgcggcgcgcgataccacaacacacacgctgtgcaccgagaagaggcgaacacaaaccactcattttcgcggcgccttccctacaggaccgcacacacaccccccccgatgcggggacggccgacacaccagagcgagccacaccccctccagacggttatctgcccccgcccggggcacaaaacaacaaccacggcgcatgataggggcacacaaacgccatctacagaccg

SEQ ID NO: 375381 - DNA, 568 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccaaaaccacatccccactcaacaaacatgt

SEQ ID NO: 375382 - DNA, 543 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcacccctcgtgccgaattcggcacgagcaaagaactta

SEQ ID NO: 375383 - DNA, 833 bp, Homo sapiens
gtcggcgtcccccacttcttagaggaacaagtggcgttcagccacccgagattgagcaatcacaggtctgtgaggcccttagatgtccggggctgcacgcgcgctacactgactggctcagcgtgtgcctaccctaccccggcaggcgcgggtaacccattgaaccccattcgtgatggggatcggggattgccaattattccccatgaacgaggaattcccagtaagttccggtctttcgcccgcccaaaacccccgcagactcagggcaaagggaatgccacaggtcccagcaccgatggcattccctttgccctgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcgtacctataaatacgtactataaagcttttgttcacacacacgcctgaagtatcctgtaagcactctgtagtatagcagataagtcttcatggcttttctggtcttctgctgcgcagggttcattgagatttcgtatgtaatag

SEQ ID NO: 375384 - DNA, 709 bp, Homo sapiens
gtcggcgtcccccacttcttagaggaacaagtggcgttcagccacccgagattgagcaatcacaggtctgtgaggcccttagatgtccggggctgcacgcgcgctacactgactggctcagcgtgtgcctaccctaccccggcaggcgcgggtaacccattgaaccccattcgtgatggggatcggggattgccaattattccccatgaacgaggaattcccagtaagttccggtctttcgcccgcccaaaacccccgcagactcagggcaaagggaatgccacaggtcccagcaccgatggcattccctttgccctgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttgtcaaacggtgccgagctcga

SEQ ID NO: 375385 - DNA, 1164 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagaggtagccccagggaggggagggaaagggacggtggagacctgggttagaccaagggttatagaaggaaagagagctacctcagggcttgaatgtggactagtcgtgaggagcagagtgcattgcttcctctagggttttatttcctccccaccctccaaattgttagctcacagccttacaggaaaggacgggggcgggcgcctgccctcagtctgatttctgagcgtccctgggtctgaccttaagggcaagggcagggagcttcacatttcaaatacagttgtggttacggcagcccagtacttttggccctccttgctgttcggttctcctcccttctcccaacctcctcactggtgttgctgggtgtggtcctcaatacagaatagagacccttgggcctgtgtcaccagacttctgaccccttggcaacagccagatggagactggtcgccttttgagcctcagctctcttcctcttgttctcctagggtgggagtacagcagccaaacgctgaacttagtcccatccacttccatcttatcctttgtgcccttcatccccctgcatcttgtcctttttgccctctggtacctcccagtgccccatcatctctacccccagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375386 - DNA, 563 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagaggtgccccatcatctctacccccagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375387 - DNA, 386 bp, Homo sapiens
gcacgtgtgtgtgtcgatctagaggctccccgttcgacggaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375388 - DNA, 374 bp, Homo sapiens
ccccgactagcccgacaggaggaaacggaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375389 - DNA, 368 bp, Homo sapiens
  misc_feature (1)..(1): n is a, c, g, or t
nagagctcggcccgttttacggaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375390 - DNA, 1138 bp, Homo sapiens
ggcccacagcagcacacctgggagtagagcagatgcaaggcagcgaggtggagacttgctgaggaaaggcatacgttaatgtatgtgtgaggttaacccaggaggttgaattccaaaatttccccttcccctttcttccttttactcaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcctagtttatgaggtggttaaggatatcggtggggtgggctggagcggtgtcgggttaggtctgagagaaggcctcgcacaaaacactgtacaaacccgaaaggaagtctgagagacgaaccgccttcctccctgaagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagtttta

SEQ ID NO: 375391 - DNA, 856 bp, Homo sapiens
ctcaggctgttctctccagattagggggcagtttgtctatctggccccctgtggattagcattctttattggtttaggattagacgtcattcaggttgaacggagttccctgaggtgggtgggtgcgtgtttatgtgttgaggggactattcctagtttatgaggtggttaaggatatcggtggggtgggctggagcggtgtcgggttaggtctgagagaaggcctcgcacaaaacactgtacaaacccgaaaggaagtctgagagacgaaccgccttcctccctgaagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagtttta

SEQ ID NO: 375392 - DNA, 485 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375393 - DNA, 308 bp, Homo sapiens
acaggcgaagggcaagagggttggacacgaagccacaaagctacttgggttcctccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375394 - DNA, 1971 bp, Homo sapiens
ggcccacagcagcacacctgggagtagagcagatgcaaggcagcgaggtggagacttgctgaggaaaggcatacgttaatgtatgtgtgaggttaacccaggaggttgaattccaaaatttccccttcccctttcttccttttactcaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcctagtttatgaggtggttaaggatatcggtggggtgggctggagcggtgtcgggttaggtctgagagaaggcctcgcacaaaacactgtacaaacccgaaaggaagtctgagagacgaaccgccttcctccctgaagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatcatcttgggtcaagtagagtgtatactatatcctatgttgtggagaatttatatgttggagactaactgaatttaagtgacccattaaaatctagcacacctgtatgaaaaatcagtgtagaagaatacctcatgtgcagatgctaggtggcaggccagtctcattcatctgactagctctcaacagtattcaaggtacatctggagtctcagcagagttactgtactcaaatggcatgtgtctccaagacagcttatgaatatctaaaaggccagctacctgcctaggagccactatatatatagatagatgtaggttatgaacccagttcataggccaccttgagttagaattttggtacctacaacatgcttgattttgagtgattaaaaaaaaataatttggctgggtgctgtggctcacgcctctaatcccagcactttgggaggtcgaggcaggtagatcacgaggtcaggaattcaagaccagcctggccaacatgtgaaaccccgtctccactgaaaatagaaaaattagctgggcatggtggtgggcgcctataatcccagctattctggaggctgaggcaggaatcgcttgaaattggaaagcagaggtttaatttcttcttcatatttgtcctccttttcagaatacctgtgggagaaaccaaaacactgctttaagacaaggaggccagccaggcatggtggctcatgcctggaatcctggcactttgggagcctgaggctggtggatcacaaggtcaggagttcgagcacagcgtggcaacatggtgaaacccgtctccacaggtaccgagtcgattcg

SEQ ID NO: 375395 - DNA, 1711 bp, Homo sapiens
  misc_feature (1376)..(1376): n is a, c, g, or t
ggcccacagcagcacacctgggagtagagcagatgcaaggcagcgaggtggagacttgctgaggaaaggcatacgttaatgtatgtgtgaggttaacccaggaggttgaattccaaaatttccccttcccctttcttccttttactcaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcctagtttatgaggtggttaaggatatcggtggggtgggctggagcggtgtcgggttaggtctgagagaaggcctcgcacaaaacactgtacaaacccgaaaggaagtctgagagacgaaccgccttcctccctgaagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttaaaaaaaaaacaaaaaaagcaacaacaacaaagaacaaaacaacctgcggggcgccttatatgcgggggggcgggacaacaaggagggtaccggaacgtcggccgagtggccaatagtgtggtgccctagacccagctttctgtggtgcacacggggggtaaacctgggcggcgcccatatggggaggccggaataaatcggaaaaggcgcgtaccgtggacgccctggtgcggaaacncgggcgcgaagcacgcgctaggcacagagcggcggaccacccagttgggagcaaaacaagctgggccgggcgaaacagtggaaatgaacgaacgaaacacggacagaacagacggaaaggcccgcaaacaagagcaagcacaaagcacgctaccacgaccaaacaaaagcgacgcacggcgcaggcagagaaggacacaacgacgacgcgcgcagtcccacagacctcagcaccgcgacgaggccaagggagagacaacaacagaccaacgaaaagacacaacagacagcggacgtacgacggagatcccagacagaccgcgcccagcaggcgaa

SEQ ID NO: 375396 - DNA, 1196 bp, Homo sapiens
ggcccacagcagcacacctgggagtagagcagatgcaaggcagcgaggtggagacttgctgaggaaaggcatacgttaatgtatgtgtgaggttaacccaggaggttgaattccaaaatttccccttcccctttcttccttttactcaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcctagtttatgaggtggttaaggatatcggtggggtgggctggagcggtgtcgggttaggtctgagagaaggcctcgcacaaaacactgtacaaacccgaaaggaagtctgagagacgaaccgccttcctccctgaagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttaaaatacccaaaattaactgggatccaaaaacaactccaggaggggatggaaaaaaaaa

SEQ ID NO: 375397 - DNA, 2385 bp, Homo sapiens
ggcccacagcagcacacctgggagtagagcagatgcaaggcagcgaggtggagacttgctgaggaaaggcatacgttaatgtatgtgtgaggttaacccaggaggttgaattccaaaatttccccttcccctttcttccttttactcaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcctagtttatgaggtggttaaggatatcggtggggtgggctggagcggtgtcgggttaggtctgagagaaggcctcgcacaaaacactgtacaaacccgaaaggaagtctgagagacgaaccgccttcctccctgaagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacgggagaaagaactggcaaaagtcactatcaagaaggaagatctggagctaatagtgagtggtagtgcctaactagtgtatgcggaggggaggctattctgcttaatttgggttgtttcctgaaacaagcggagtcagtatatttggtggcacattaatgcctgggaacctatgtaacatgatttttttctgcagatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatcatcttgggtcaagtagagtgtatactatatcctatgttgtggagaatttatatgttggagactaactgaatttaagtgacccattaaaatctagcacacctgtatgaaaaatcagtgtagaagaatacctcatgtgcagatgctaggtggcaggccagtctcattcatctgactagctctcaacagtattcaaggtacatctggagtctcagcagagttactgtactcaaatggcatgtgtctccaagacagcttatgaatatctaaaaggccagctacctgcctaggagccactatatatatagatagatgtaggttatgaacccagttcataggccaccttgagttagaattttggtacctacaacatgcttgattttgagtgattaaaaaaaaataatttggctgggtgctgtggctcacgcctctaatcccagcactttgggaggtcgaggcaggtagatcacgaggtcaggaattcaagaccagcctggccaacatgtgaaaccccgtctccactgaaaatagaaaaattagctgggcatggtggtgggcgcctataatcccagctattctggaggctgaggcaggaatcgcttgaaattggaaagcagaggttgcagtgagctgagatcacactactgtactactgtactccagcctgggggaaagagtgaaactccatctcaaaaaaaaaaaaaaaaaaaagcccgggcacagtggctcacacctgtaatcccagcactttgggaggctgaggcagtcggatcatgaggtcaggagttgaagacaagcctggccaacatggtgaaaccctgtctctactaaaaatacaaaaaaaataaaattagccaggcgtggtggtgcatgcctgtagtcccagctactcaggaggctgaagcagaagaattgcttgaaccagggaggcggaagttgcagtgagctgagattgtgccactgtactccagcctgggtgacagagcgagactgtctcaaaaacaaaacaacaaaaaagaatttaggggccaggcatggtggctcatgcctgtaatcccaacaccttgggaagctgaggcaagacgatcacttgagcccagcagtttgagaccagcttgggcaacacagtgagatttcgtctctaccgcgctccccccaccacc

SEQ ID NO: 375398 - DNA, 322 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaacctctgccaacagccgtcgagggaccgtcagaacgca

SEQ ID NO: 375399 - DNA, 322 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctctacaagccgccacaaactctacaagcctgcca

SEQ ID NO: 375400 - DNA, 752 bp, Homo sapiens
cctttcccatagcggccatgtctgtgattggagacagaaggtcccgggagcagaaagccaaacaggagcggtaagtcttcaggggcagccaactttaacagttcttccctccccggtccccagacaaaaataaaaaccattattaagcctttataccgttcttcaaatttatcaccaattcctgcagatctaggcgccacaactttactcttgttagcagaaggcctcctggcaacacctgctgccaagactccaggggaaaggagtattagtgggagtttttattttcaatcaagggtttatcaagatttatttacagggcacttctgggaatgacccttcctgggagtttatggtgttggttgagaatgaggactaatatatttaaatatttttgcacgggagaaagaactggcaaaagtcactatcaagaaggaagatctggagctaatagtgagtggtagtgcctaactagtgtatgcggaggggaggctattctgcttaatttgggttgtttcctgaaacaagcggagtcagtatatttggtggcacattaatgcctgggaacctatgtaacatgatttttttctgcagatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctt

SEQ ID NO: 375401 - DNA, 477 bp, Homo sapiens
  misc_feature (14)..(14): n is a, c, g, or t
  misc_feature (20)..(21): n is a, c, g, or t
  misc_feature (23)..(23): n is a, c, g, or t
  misc_feature (25)..(27): n is a, c, g, or t
  misc_feature (29)..(29): n is a, c, g, or t
ctctagtacaacanctcatnncnannncncgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 375402 - DNA, 853 bp, Homo sapiens
  misc_feature (14)..(14): n is a, c, g, or t
  misc_feature (20)..(21): n is a, c, g, or t
  misc_feature (23)..(23): n is a, c, g, or t
  misc_feature (25)..(27): n is a, c, g, or t
  misc_feature (29)..(29): n is a, c, g, or t
ctctagtacaacanctcatnncnannncncgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccaaaaaaaaaaaaaaaaaaaaaaaaaaaagggggggcgcggcccaaaagtttcccccgcggggggccccaagtttagcgggtaccccggttttttgggcacaagggggccccataataggggagcgaataaacaccctaggacacgtgcacgcgttaacaacgctcggaacggggaaaaccgtgcaacgcggggacccttgacgaaggaccctaactccgggggggttggacacaaagtggggccacaataatcctagagaaagattaaaaggctctagagggaattttaaaactttgaaggtgctaaaggtggttaaacacaggaaatagatcagtggctctgaaaaactgggaaagaggtatgataggacaattt

SEQ ID NO: 375403 - DNA, 538 bp, Homo sapiens
tcagtctggactctaccacttgggtctccagattttctgttacgtccttgtgggtcaggatatttctggaagtcactccgtgaggctggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagtttta

SEQ ID NO: 375404 - DNA, 270 bp, Homo sapiens
  misc_feature (1)..(1): n is a, c, g, or t
nagagctcggcccgttttacggaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttgtcaaacggtgccgagctcga

SEQ ID NO: 375405 - DNA, 755 bp, Homo sapiens
  misc_feature (34)..(34): n is a, c, g, or t
tttaaacccctttactactactatgctgcgagangagacagaaggggacagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccaaaaaaaaaaaaaaaaaaaaacttccgggggtatctaattgcgggtgtgggggaaaaaggggattggaattgggcaccgtgtggcacttagggggtgttcctggacccacgctttctgtgttcaacggcggcaaaatccgccggccccccctatagggaggcggatataaataggaaaaggccggttacctgtgccctctctcac

SEQ ID NO: 375406 - DNA, 930 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccttgagcgcctggtttgactggggacttggggggatggggttggaagaatgactgccctttcccaccaaaaaagggagaactctttagattcagattgtgggtatgtagacttaataagtgaaacatcacagaagaagcctttattatacaatgacaaccaaacaagtactccggatatgcagtagaggaatcctctaagaaccatagagacttcttttctgtgatttttgttccccacccttgaacaccatctctaggatggagttggcctaagagtgaatgctgcaagatctgtgtttatgcctcttttcctcattcttcctcagtttgttcgtctgcttgaaagttggccaaaaaatcctgctgctcaccgacttcccgtggtcagctg

SEQ ID NO: 375407 - DNA, 1229 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccttgagcgcctggtttgactggggacttggggggatggggttggaagaatgactgccctttccctcatagctgtgtaaccaaaggctctggttagagaatatgaagggccttagcttttagacctgttctacctcctcaccaaatataatggcagacccatgtgtgtctggaatggccttgaattgctctttccttaaaatagctagctcttcaggagagtatctaaggcccactccatcttacctgaaccagttggtaagggtaaccatgacatagagtgaggcaaggaagaagacgaagtggaaggcagaatagttgtaggaaagatgctggacttggactggaggagctggaggggtttcttggtcagctggcctcgcagccccacccctttgccctggagagaggaaatggctgctgggagcagagctgctgaaacacctcttcccctctcccccaactacctttgttaaggctcttgagggttcttatggcactccacagagatctaccacttcttatggttcctcacttggcactcacctttgtctgcctccactgtttcagggcagcagaaacacagtgagggcttctgcaaaacagaacgcaggttttggaatggtcttaaaagatgtgagggtgttaatctaggaaacttcccccgtgaaaaaggaaaggatggggaccgag

SEQ ID NO: 375408 - DNA, 716 bp, Homo sapiens
gtcggcgtcccccacttcttagaggaacaagtggcgttcagccacccgagattgagcaatcacaggtctgtgaggcccttagatgtccggggctgcacgcgcgctacactgactggctcagcgtgtgcctaccctaccccggcaggcgcgggtaacccattgaaccccattcgtgatggggatcggggattgccaattattccccatgaacgaggaattcccagtaagttccggtctttcgcccgcccaaaacccccgcagactcagggcaaagggaatgccacaggtcccagcaccgatggcattccctttgccctgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttttgcaggcagggatcctctagaacaccg

SEQ ID NO: 375409 - DNA, 716 bp, Homo sapiens
gtcggcgtcccccacttcttagaggaacaagtggcgttcagccacccgagattgagcaatcacaggtctgtgaggcccttagatgtccggggctgcacgcgcgctacactgactggctcagcgtgtgcctaccctaccccggcaggcgcgggtaacccattgaaccccattcgtgatggggatcggggattgccaattattccccatgaacgaggaattcccagtaagttccggtctttcgcccgcccaaaacccccgcagactcagggcaaagggaatgccacaggtcccagcaccgatggcattccctttgccctgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttatgctccgtactgatgcccgcttactga

SEQ ID NO: 375410 - DNA, 768 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagtttta

SEQ ID NO: 375411 - DNA, 1391 bp, Homo sapiens
taaagagggtctaagaggcagtactataggtctagtacgagctgggtgcgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagaggtagccccagggaggggagggaaagggacggtggagacctgggttagaccaagggttatagaaggaaagagagctacctcagggcttgaatgtggactagtcgtgaggagcagagtgcattgcttcctctagggttttatttcctccccaccctccaaattgttagctcacagccttacaggaaaggacgggggcgggcgcctgccctcagtctgatttctgagcgtccctgggtctgaccttaagggcaagggcagggagcttcacatttcaaatacagttgtggttacggcagcccagtacttttggccctccttgctgttcggttctcctcccttctcccaacctcctcactggtgttgctgggtgtggtcctcaatacagaatagagacccttgggcctgtgtcaccagacttctgaccccttggcaacagccagatggagactggtcgccttttgagcctcagctctcttcctcttgttctcctagggtgggagtacagcagccaaacgctgaacttagtcccatccacttccatcttatcctttgtgcccttcatccccctgcatcttgtcctttttgccctctggtacctcccagtgccccatcatctctacccccagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcaaaaaaaaaaaacaaaaaggggggggccacgcagaaaagcgacacgggggggcggacacacgcaaagagcgagccccacagaccgtgagaaacacagagggggggccacaacagagagagggcgcaacgg

SEQ ID NO: 375412 - DNA, 744 bp, Homo sapiens
gtcggcgtcccccacttcttagaggaacaagtggcgttcagccacccgagattgagcaatcacaggtctgtgaggcccttagatgtccggggctgcacgcgcgctacactgactggctcagcgtgtgcctaccctaccccggcaggcgcgggtaacccattgaaccccattcgtgatggggatcggggattgccaattattccccatgaacgaggaattcccagtaagttccggtctttcgcccgcccaaaacccccgcagactcagggcaaagggaatgccacaggtcccagcaccgatggcattccctttgccctgagtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctgacagaggaggagcacagaggagggtgtccggggaagcagttagatgagttaagtgtgatgcacaggaaaatagtatcgtagcctatcaaagtccctctgcgctgccagctgtccacctcctct

SEQ ID NO: 375413 - DNA, 1676 bp, Homo sapiens
  misc_feature (1167)..(1167): n is a, c, g, or t
ggcccacagcagcacacctgggagtagagcagatgcaaggcagcgaggtggagacttgctgaggaaaggcatacgttaatgtatgtgtgaggttaacccaggaggttgaattccaaaatttccccttcccctttcttccttttactcaggttctgtttcaagctgattccagccatttgggattgccgcccactgacaacttagtagggctttcattataagcaggcttgagatatctgacctttctctcgacctaaacacctggggctggaaacatggcgggagagatttacagattatacctggggcaacgaaccagaacgacattagaggagaaaagaggcctgtcgtttttattggcttctgcacgtcttcctccccagcttcggccactctccccttcgcaccctctcacctgacagaagggacttttcctagtttatgaggtggttaaggatatcggtggggtgggctggagcggtgtcgggttaggtctgagagaaggcctcgcacaaaacactgtacaaacccgaaaggaagtctgagagacgaaccgccttcctccctgaagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttaaaaaaaaaaaaaaaaaaaaaaaaaaaaanaaaaaaaaaaaaaaaaaaaaaaaaaaaaaaaaaaaaaaaaaaaaaaggaggaaccaaaaaaccaaataaaacctaaaaaaaatcaaataacaattaaactgaaaaacatttaacaaaaaaaaaaaaacttaggggggggccccgaccccaattaccccctatgggagggcatttccaattcacgggccggcgtttaaacaattaggaatggaaaaacccctgtttttaccaatttaacagccttaagggcaaatccccttttgcagttggggtgataacgaaaaaggcccgcccaatcggcctttacaaagagtggccacccataagggcgatgggaaaattaaagctttaattttggataaaaatcccgaaaatttggtgaaaacccctaaattttaaaccaatggcccaaatcggggaaatcctttaaacaaaaaaatcccccctaagggtaagttgtttccaatggaaaacgatcccttttaagaacctgcctcacgtaaaaggga

SEQ ID NO: 375414 - DNA, 397 bp, Homo sapiens
gtccagacaacctgcgttcaagtcctgcctccacccagtcttagttctgtgacctgaatgacatcatttcatcctccctctgcctcagttcccttatccttaagaacaatgcctagctgggcgtagtggcttatgcctgtaatcccagcactttaggaggccgaagtgggcagatcacttgagatcaggagttcgagaccagactggccaacatgacgaaaccccatctctactaaaaatacaaaaattagccaggcgtggtggcaggtgcctgtaatcccagctactcgggaggctgaggcaggagaatcgcttgaacccaggaggcggaggttgccatgagccaagatcgctccattgcacttcagcctgggcaacagagtgagactccatctca

SEQ ID NO: 375415 - DNA, 1830 bp, Homo sapiens
agccagagagacgcagctaggcctgcacggctgtggagagatcctgccacgggccttgttcaccatgtcggtgctggatgcgctttgggaggatcgggatgtccgtttcgacctgtccgcgcagcaaatgaaaacaagacctggagaagtccttattgattgtttagattccattgaagacaccaaaggaaataatggagatagaggtagactcttggtaacaaatttaagaattctctggcactctttggcattatcaagagtcaatgtttctgtcggttacaattgcatattgaatattacaacaaggactgctaactctaaattacgaggccaaactgaagctctctatatactaacaaaatgtaacagtactcgttttgaatttatatttacaaatttggttcctggaagccctagactttttacttctgtgatggcagtacacagagcttatgaaacttctaaaatgtatcgtgattttaaattaagaagtgcactaattcagaacaagcaactaagactgttgccacaagaacatgtatatgataaaataaatggagtttggaatttatccagtgatcagggcaatttaggaaccttttttattaccaatgtgagaattgtgtggcatgcaaatatgaatgatagttttaatgtcagtataccatatctgcaaattcgttcaataaagattagagattcaaaatttggtttagctcttgtcatagaaagctctcagcagagtggtggatatgttcttggctttaaaatagatcctgtggaaaaactacaagaatcagttaaggaaatcaattcacttcacaaagtctattctgccagtcccatatttggagttgattatgagatggaagaaaagccccagccgctcgaagctctgacagtcgaacaaattcaagatgatgtagaaatagactctgatggtcacacggatgcttttgtggcttattttgctgatggcaataagcaacaagatcgtgaacctgtattttcagaagaactggggcttgcaatagagaaattgaaggatggattcaccctacagggactttgggaagtaatgagttgattgaccttgagttgagatggatttctattaaagatatctctagtttaaagatactagtcacctgccataagtcatggaatagtttttatatttacagcttttatatttaaaacttgtaagagtttttttaatgattgaggaaaaagtcatttagaaaacttcagttttcggccagcgcgtcgagggaggggccagcgacacatggcctagtaaccgtccggccgcggcgctggcttaagccatggctgagggtagctggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggccgaagctggactgtactgctgccatctctggctcactgcaacctccctgcctgattctcctgcctcagcctgccgagtgcctgcgattacaggcgcgcgccgccacacctgactggttttcgtatttttttggtggaaaccctgtctctactaaaaatacaaaaaattagccgggcgtggtggcgggcacctgtagtcccagctactccggagaggctgaggcaggagaatggcgcgaacccgggaggcggagcttgcagtgagccgagtaaccgacgctgcactccagcctggccgacagagcgagactctgtctc

SEQ ID NO: 375416 - DNA, 436 bp, Homo sapiens
gttgttgatgtcattaggtcatgagggctctgccagcaggaatggaatttagcgtccttataaaagacccagagagatcccttgccctttgcagcatgtgaggacacagagaaaagagagacacctatgaaacaagaagtagtaggttgtcaacagatgctgcatgtgctggtgacttgatcttgggacatcctagcttcggggactgggagacatacatttctgttgtttataaggcatccaggggtatgggtatttttgttattaggcagcctggaatggaacaaaaacaggatataatttgctgagttttgacatgtcccttctacttcttcagactttcagcatctgctgtctcctcagttgaatttgtaatcaaagcataagaaatatcaggtataggccaggtgtggtggctcacgcctgtaatcccagc

SEQ ID NO: 375417 - DNA, 568 bp, Homo sapiens
gttctcagcgtcctgctcacaatcccttttactatgccactgacttacccagactggctaggacatctctatttgcattgcattgcaatatggactgaggtgagcttgcctatgaaatcagctgtgaacttattttttgttaactgtgattttaaagggcagggaggagaaaatgaatactgagggaaggaaaggagacctaacatttattgagtccttggagttcttgagatagatgcctcatacacgttaacttatgcatcctcacaatgatcttgggaggtgttatttactccattttacagaggaggaaatggaggttaaatcacttacacaggctgggcacggtgactcacgcctgtaatcccagcactctgggaagccaaggcaggaggattgcttgagcccaggggtttgagaccagcctgcctctacaaaaaaataataagtttttaaaaatcactgcccaaagttccaaagctagtcaacaaagaaaccggttacaaatttgctcttcatttagtgtaaaaatcaatgaaacttttctgaatgtttcagtctttaaaaa

SEQ ID NO: 375418 - DNA, 473 bp, Homo sapiens
atactgcagcctatgggccaacagaggcagctgggggaccaaatgccccattgtccttgccctcctaccccctgagcacctgggatacctccccccagcctgttgctgctgtccaggaaggtcaccagcctgggtcactgggcacagaacaggcgtaagtggacagataggagggagactatctgggtcacaagagggcttgggctgtttaaagtttcaaataatgaacaaatgtatcttgaactacatcaccaaatctgagccagaggagagacttgaggtagcagagaagaggaggccttttcaggatgtatctgaatagctctgaagctctgaagaaaaggttcagtaggccaggcaccagtggctcacagctgtagtgccagcactttgggaggccgaggcaggaggatcacttgaagccaggagtccaagaccagcctgaacaacatagtgagaccctatctctacaa

SEQ ID NO: 375419 - DNA, 1019 bp, Homo sapiens
atgctcggctgtggattccgtacttgaggtgttgaggcttcccacagcggggaagtttgcgcgtttcctccccaattgtgtctccgggcgctttctgcgttgccctcccatgatgtgtctgtgccccaaaaggtttgttgcacatatgtttgccgcccctcgtttgcgctatatgtgttgctctgggtttacagccggcatgttccttcatgagcgccatcagtcgcgcccccccgtgttgttgcttggcacggtccaccgtggggttctatgatcgctggaaatccttggggtgctgttggttccctagggttttctgagccctttctgtgagatttaaagggcttttccgtacgacaatattgggccgtacatctagttcgttgccttagagagatgtgaaaagttttgccgattctgtctagctccttcttggggccccggcggcgaggcacccgtaggtatcagtgcatgtcccggtatatccggtcgtctcccctgttgtgttacgacatatagcccagttgagggaacgctcacgatttgcactcccccatgcgatcctccgactgattttctctttctgttcgtcccgttttcccctggtctgtgacacggtatgcccctttctcacgtatgcacggcggactccggccactgggtccagagcacccctgcttcatggggaaaccctggtttgtcgttcccacaccaaactgagttcggaccacataacaccttccactttttcaccccacgagcgtcagcagccaacttttgtggccatacgcttttcatagagaagtatcgaagtttgcgttcatcgtccacttcaatgagtttctggcagcccgtggctgggaaggagatgttcagcttcatcttgaagcagctgtacgcctccgaggccttgtccccctccccctcaaccccaccatatgaattgtacagaatatttctattgaattcggaactgtcctttccttggctttatgcacattaaacagatgtgaatattc

SEQ ID NO: 375420 - DNA, 315 bp, Homo sapiens
ttggggaggcccatcccccacctgcaagcggttttcgtgtgtgggtccctgtgccccaccctcgttcccattggctttctctccttggcctttcatggaagccagttagtaaacttcctatttttttgagtcaaaaaacatgaggggtactgttggatgggacatttttgttggtcctacaatctagtaatgtttaagtaatggccttgtccccctccccctcaaccccaccatatgaattgtacagaatatttctattgaattcggaactgtcctttccttggctttatgcacattaaacagatgtgaatattc

SEQ ID NO: 375421 - DNA, 2968 bp, Homo sapiens
agtggcgcgcaggcttttgtaacgttcccagcgccgcgtttgaattcggggagggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattctttttcttgtatttcctgaggggtgccagggcctgggatccagcgaacatctctgcttcatcagccccaggctgcccagcctctgccagtcttgtgggggaaagggggtgacagtgtctctctgtggaccaggctggagtgcagtggcatgatcctggctcactgcagcctcgaactcctgggctcaagtgattctcccacctcagcctcccaagcagctgggactacaggcgtgcgccaccatgcctggctaattttacaaattttttgtagaaatggggtgttgccatgttggccaggctggtctcgaactcctgagctcaagtgatcctctcactcagcctcccaaaatgctgggattacaggtgtgagccactgcacccagcctgattctgaggccagccacaggctcagctcttcagtgagccagcacggagaccatctgtgtggcatccagcccacctcacctccctgtggccccaggcatggcctcctggcctctgagtctggcgggtagtagggcaggaagaggctctcagaggcgcagctcctcatggctcggtgcgtgtggaggagcagccgtggggagcggtttgtgagtactggacgaagccatcagggacttggccgagtgcctgtcgcacctcaactgggagctccctgtagtggtgcttcttgttcctcacagcacggagcaggtctcgcactgatgtccccttataggaccggaactttctcag

SEQ ID NO: 375422 - DNA, 2642 bp, Homo sapiens
agtggcgcgcaggcttttgtaacgttcccagcgccgcgtttgaattcggggagggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattctttttcttgtatttcctgaggggtgccagggcctgggatccagcgaacatctctgcttcatcagccccaggctgcccagcctctgccagtcttgtgggggaaagggggtgacagtgtctctctgtggaccaggctggagtgcagtggcatgatcctggctcactgcagcctcgaactcctgggctcaagtgattctcccacctcagcctcccaagcagctgggactacaggcgcgggcgggtcacttgaggtcaggagttcgagaccagcctggccaacatggtgaaacccccatctctactaaaaaaaatataaaaattagccgggcatggtgatacacacctgtaatcccagctactgggaaggctgaggcccggaattgcttgaacctgggaagcggaggttgcagtgagc

SEQ ID NO: 375423 - DNA, 2324 bp, Homo sapiens
agtggcgcgcaggcttttgtaacgttcccagcgccgcgtttgaattcggggagggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggtgagctggaggtcaccaggcgcaggagagagctggggtaggctccgcatgcctggcagtggcccatgtgggttgaatgtggagtgagcggctcaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375424 - DNA, 1785 bp, Homo sapiens
agtggcgcgcaggcttttgtaacgttcccagcgccgcgtttgaattcggggagggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccagccttgtccccctccccctcaaccccaccatatgaattgtacagaatatttctattgaattcggaactgtcctttccttggctttatgcacattaaacagatgtgaatattc

SEQ ID NO: 375425 - DNA, 1568 bp, Homo sapiens
agtggcgcgcaggcttttgtaacgttcccagcgccgcgtttgaattcggggagggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttggtaggtttcttccagaacaggtgggtgactcaggcacagccaggtgaccttttcagttgttacagactctggcctttttgagctcccaggtactgttctcagtgccctcctctctccatcccaggcctcccagttccagctcccagtgctccctgactccccagctttttttttttccagagacag

SEQ ID NO: 375426 - DNA, 979 bp, Homo sapiens
agtggcgcgcaggcttttgtaacgttcccagcgccgcgtttgaattcggggagggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagaacatcaaccgcgaacacgaataggggatcttcatagactcgcccggcagg

SEQ ID NO: 375427 - DNA, 1946 bp, Homo sapiens
  misc_feature (78)..(78): n is a, c, g, or t
aatcagacctaccctcatctcatccacacaaccagaaccgaaagagacaaaacaaataattaggctaggtaggaggcnggggttaataggccgagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375428 - DNA, 1895 bp, Homo sapiens
atgccgctgtgctggagaaggaatggggtgggggcatagggaaggagagaaacccaccaagacccctctttcatcccttgggagtccagagtccagtcctgtgcttcctttgcctggtaaccctctcccttccccaccggcctcaatccacctccccatccctcctgccctctccttcccacccacatctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375429 - DNA, 1791 bp, Homo sapiens
tcagcttctggacgcgaggtgctggggggaggggtgctggtaatggacgctagggccctggagtacccagggaggagtcccagtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375430 - DNA, 1801 bp, Homo sapiens
aaacaacacacaaaataggtcagtaacaggcacagtgtttaatcggacgaggacacttcgtgtcgtggtgttggagctctgacgccggagagatctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375431 - DNA, 1636 bp, Homo sapiens
gaaaaagggatgataatagatccccaccccttagatgagttggtgagggctaagtgagctaaacacaggagtgcttagaatgctttcctggcacatagtgagtgctaggaaagtgagttggtgttcggccacagtccattgacccttctgtcaatggtgctcagtaaagctgacagtggagaacttggcattgaaccaagttgtgaaccactgacctgtggtgtatttgagactgggggctgcatgtgggctggggacctgcagctcctttgaggccgtactgtactccaggtccccttcacattctgcttatggctgtccctctctctgccccagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375432 - DNA, 1719 bp, Homo sapiens
tggggtggaaaaaaatttcttgtgtttttatttaaatgcctactgaatccattctgtggatgaactgaactactcagcccttccatctgcctggatgctgaagatgctttccattctttgctcaaagctgggcagctctgagctgctggtgccttcaagctgtttgcctgagtggcaggtcatcctgcagggccacaccgttgggtcagaggccacggacttctcacccaacatagtccaacatgtccttctttgtttattggatttaaattaaggggtttgttgcatgcactgaacgtaacattttgatgtgtttgcaactggcttctgtcttcacagtttcttaattactccaaactggaaaactagatgcctctgactcttaccatgatagaagtcactgatattttgcccatacttaaattgattagtctttgcccctacaaccacagtgtaagctccgtggaggctggggttttgtctgttgctcactgaacctgcaacagtgcctggcacggtaggccttcagtaaatgggtcagtggaatgaaggagtgagtggaacttggtgcgctgtgctgagactttctctgcagagatatctgtgctgctgcttgtctgagcctgctggcagcagaggccctgctttgctcttctctggggccctaggcctctcaactgagcccaggtggggtgcccagcaggcttccctgttccctggtgtgggccacatgtgtggagcagaggggaagaggctggtcctgaccaactaactgtctgtctgtttctgtctcagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375433 - DNA, 566 bp, Homo sapiens
tggcgtgcgccccccgactcgcctcgccccgagacccggaaagtatattctagctaccgatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375434 - DNA, 549 bp, Homo sapiens
  misc_feature (33)..(33): n is a, c, g, or t
gggcactgcaaccccccacagaggagagcctcnggtaaactgatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375435 - DNA, 1059 bp, Homo sapiens
tggggtggaaaaaaatttcttgtgtttttatttaaatgcctactgaatccattctgtggatgaactgaactactcagcccttccatctgcctggatgctgaagatgctttccattctttgctcaaagctgggcagctctgagctgctggtgccttcaagctgtttgcctgagtggcaggtcatcctgcagggccacaccgttgggtcagaggccacggacttctcacccaacatagtccaacatgtccttctttgtttattggatttaaattaaggggtttgttgcatgcactgaacgtaacattttgatgtgtttgcaactggcttctgtcttcacagtttcttaattactccaaactggaaaactagatgcctctgactcttaccatgatagaagtcactgatattttgcccatacttaaattgattagtctttgcccctacaaccacagtgtaagctccgtggaggctggggttttgtctgttgctcactgaacctgcaacagtgcctggcacggtaggccttcagtaaatgggtcagtggaatgaaggagtgagtggaacttggtgcgctgtgctgagactttctctgcagagatatctgtgctgctgcttgtctgagcctgctggcagcagaggccctgctttgctcttctctggggccctaggcctctcaactgagcccaggtggggtgcccagcaggcttccctgttccctggtgtgggccacatgtgtggagcagaggggaagaggctggtcctgaccaactaactgtctgtctgtttctgtctcagaggaggctgaggatcctgcctgcatccccatcttctgggtcagcaagtgggtggactattcggacaagtacggccttggtaggtttcttccagaacaggtgggtgactcaggcacagccaggtgaccttttcagttgttacagactctggcctttttgagctcccaggtactgttctcagtgccctcctctctccatcccaggcctcccagttccagctcccagtgctccctgactccccagctttttttttttccagagacag

SEQ ID NO: 375436 - DNA, 212 bp, Homo sapiens
ctgctcagtggacttagggattgtcttcaggggccccagagttagagtgagtgtccagaggatgcctgacctttgttctgaccctgagatgatttctctcatgtctgggttgtggctgggagactggtgccaaatcctaccttgtgcttacaggtataccttgttagtgggcaaaccaccttttgagacttcttgcctaaaagagacctacc

SEQ ID NO: 375437 - DNA, 2228 bp, Homo sapiens
agtggcgcgcaggcttttgtaacgttcccagcgccgcgtttgaattcggggagggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375438 - DNA, 2266 bp, Homo sapiens
  misc_feature (78)..(78): n is a, c, g, or t
aatcagacctaccctcatctcatccacacaaccagaaccgaaagagacaaaacaaataattaggctaggtaggaggcnggggttaataggccgagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375439 - DNA, 2017 bp, Homo sapiens
agtggcgcgcaggcttttgtaacgttcccagcgccgcgtttgaattcggggagggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaaccaagctacatctttgtagccccatggatggcagaccgtgaacctaattcggagcgagaagcggggaaccttcccggacattaccggcctgaaggttcatcccgtggaaggaagcaagacactggctgccacgggcgcatggccccagcacgggacccgattaaggcccggcacaaaggtggaccaagccagatgcacacacgatcgaaccagacaacgacctcacgggcccctaaatagagggccccacacacagagaaggtgacctcgtaaatccccacggaatcag

SEQ ID NO: 375440 - DNA, 1071 bp, Homo sapiens
agtggcgcgcaggcttttgtaacgttcccagcgccgcgtttgaattcggggagggagcggagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaaggtgactaatgatgctttaagtttacatttattttgttttccccagaagctgtttatggagcccagcaatatcctaggaccagaaataggtctatcccacctctaaggtagccacagagcttgagagggcctgtgtctgaaatt

SEQ ID NO: 375441 - DNA, 1856 bp, Homo sapiens
gctggggaactggaactgcctgcggggcagttggagcgcccagacctggagctgctggaaagagtacccagcaagggagagcctgggacttggagctgctagagaagggtgctgggagcctcccgcttacgtatggaaagtgtctttgtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375442 - DNA, 1008 bp, Homo sapiens
cttctggagcatcgaaaacttggtggaattgtcaggcaggtgatggggagacgggcagggatatagccagaagtaaagaactcgtcattaagcagttcgttaatggttgggcgggcagtgggatctgtctgaagcatcttctggatgagggaggcggccacgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375443 - DNA, 556 bp, Homo sapiens
cccctcgcccttattacgaattatgtttggatgaaaggtatcagtaccgatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 375444 - DNA, 303 bp, Homo sapiens
ctgttctactaatctctatagtcgtaattactgtaactttctcataattcttaaaattgggtagtatgaatccaaatttttctttcaatataacactttttggttatttaaattcctttgcttttccatatgttttagaattagccagtctgtatctatagaaaatcctgctgaggccagatagggtggctcaaatctgcaatctcagcactttggaaggttgaggtgggagcgtcacttgagcccaggagttcaagaccagactgtgcaatatgggaacacagggagaccccatctttacca

SEQ ID NO: 375445 - DNA, 964 bp, Homo sapiens
ggaaaattattgttgccttaatgttttctaagcaaaggcatgatcactcaaggagaaatacacttagctttcttaaagttaatttttacgttttaataattcacatacaatcttaactcagaaaaagagaggtcccttgtacgccttactccgtttcctccaatggtaacatcttggtaatatttccaaaatggtaatatttgcaaatagtggccgggcgtggtggctcacacctgtaatcccagcactttgggaagctgaagtgggtggatcatgaggtcaggagatcgagaccatcctggctaacacagtgaaaccccgtctctactaaaaatataaaaaattagctgggtatggtggtgggcacctctagtcccagctactcaggaggctgaggcaggagaatggtgcgaacccaggagacggaggttgcagtgagccaagatcgcgccactgcactccagtctgggcgacagaggaagactccgtctcagaaaaatgaatgaatgaataaataaataaaatttgcaaatattgcaaatgccacagtaccaggagattgacatttatacaagcaaggtacagaacatttccgtcaacaccgggattcatcatgttgcctttttatagtcatgaccccttctattcagtgctgctcctccttccctccttaacccctggcaactactaatctattccccactcttataatttattcatttcaagaatgttacttaaatggaattctacatgtaacctttgggattacccttcgtccactcaccataattctgtggagattcgtccaggttattgtgggtatcaatcatttgttgtttttttaaaaaaaattactgaggactatttgatgctgtggatatataccacagtttaaccattcatctcacaaaagtcgtgtatacattgtttccccagttttggctattaaaaacaaggctgctat

SEQ ID NO: 375446 - DNA, 521 bp, Homo sapiens
  misc_feature (492)..(492): n is a, c, g, or t
  misc_feature (494)..(494): n is a, c, g, or t
  misc_feature (498)..(498): n is a, c, g, or t
  misc_feature (500)..(500): n is a, c, g, or t
  misc_feature (502)..(504): n is a, c, g, or t
  misc_feature (507)..(508): n is a, c, g, or t
  misc_feature (510)..(510): n is a, c, g, or t
  misc_feature (512)..(513): n is a, c, g, or t
  misc_feature (518)..(520): n is a, c, g, or t
ggggcgttcgggaaggtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagntngtantngnnnccnngncnncctcnnna

SEQ ID NO: 375447 - DNA, 552 bp, Homo sapiens
gcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaagctctgtttattaattaaatatagtccagtcatcttttcatcttttttgttaacctacttaatgtgacaagtgagaaaaatgactgacacttctttttgtttcctaagggttttgaaaagtttcttcctaggctgtgtgcggtggctcacacctgtaattccagtactttgggaggctgaggcaggcggatcacctgaggtcaggagttcgagaccagcctggccaacatggtgaaaccctgtctccagtaaaaatacaaaaattagctgggcatggtggtgg

SEQ ID NO: 375448 - DNA, 2267 bp, Homo sapiens
  misc_feature (2227)..(2227): n is a, c, g, or t
gcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggttgtaaacccatattatttgcgtgtacgaaggaagaatcctgtgacaagcacttactccaaaatgagtctacagttataccaagtggatagtagaacttatctactggatttccgtagtattgatgatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaataaacagaaaactttgcttatttcttttgcagcaataagcatgcataataagtcacagccaaatgcttccatttgtaatcaagttatacataattataaccgagggctggcgttttggaatgcaatttgcacagggattggaacatgatttatagttaaaagcctaatatgcagaaatgaattaagatcattttgttgttcattgtgcagtatgtatatagcataatatacacagtgaattataggtctcaggcttacttgatttttggctattttatatttagtgtacacagggctttgaaatattaatttacataaaggccttcatatattattacgtgttatatattacgtgttataaatttattcaataaatatttgcctagaattcccaagacctttataggtgattttgttttctgggctccttaacttcataaatagctagtatcttccagcagtagtaacagtctggataacttcttccatatccctccctctttgtttttttgagacagagcgagactctggctcataaaataataataataatnaataaataaaaaataaatgtttcaggtaaacccaaaaaaa

SEQ ID NO: 375449 - DNA, 1675 bp, Homo sapiens
gcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggttgtaaacccatattatttgcgtgtacgaaggaagaatcctgtgacaagcacttactccaaaatgagtctacagttataccaagtggatagtagaacttatctactggatttccgtagtattgatgatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaata

SEQ ID NO: 375450 - DNA, 3416 bp, Homo sapiens
aaaaaaataaaagtttcttcccattcatgtatttttctaaccccattgatggtcatttaagcctgtgttcatgttttgcccttgtgcttatcagctgttatcttctcattctttcctgtctcctggaaagatgctcttctggtaatgtttggtgccccattgctgtaaaaccaacagtgatctgctagtaaaaactcttgacctccaaatgcccacatgatgtcagttagcctcactagtgagaatgcggtagtagaaagggtttttccccatcctgcttatacctgaacatatagataacaaaatttcaggaatccaaggtttcaaaagggcagtaatcttactgttgttttacagttgccagttatagagtctacaaataactatttcctgctcagcttctgctttgttatgcaggcaataacttaaagatgcttaggtttttctcctgaactggctgactcaaacttgtttcactcttacctcttctcatttgttgagtgctaggttttaaataccatccatatgctgaccacccctaaatgtacatctcttgctttaagatctcttcttacaccagacttatttgctcactgctgactttacatttccatttggatgttcgcaagacgtttaaaactcaacccggcccaaaatgaactctttattactctcccaaacctgctcttcccacagttttcaccatcttggctaacagccaatgacccagggctaaaacttaggaaccatttttaacttccctgtttctttcactttctaccatgcatttcatttcttccttcacaatcaagctaggatttgattgcttctcagttcctttattgctgtcaacctggtctcagccaccatctgtctcatgaaatcctgaagtaacctcctgtggctacctttactgttgacagttaattcttcacattgctgccatagttttacttttaatatgccagatcacatgactgcttaaaacgtacgatagcttttcatcttccttggagtaaaagccaaagccttatcatggcttgtaaaattctgtgtcttctggcctgcagttaacacctttgactctacatcctatttctctctaatattcctcgaacatgccaagcaggcttctacttggggacctttgcagttgctattccctctcccagtttcgctttcctcctagataattacataatttgttcccattcttcttttaggctcagctcaaatgttactttattagaggctttcctttagcactctgtatacaaagattccccttcatttgctttatttttcttcatagcatgttccaccacctgagatattgcttatttatttagtgtctgtttcctggttcctggaacatgaactccatgagagcagagaatttttgtttcctgcagtttttctagctcctagcctagtacctggtatactataggtgcttagtaaatatttattgaatgaatgaatatatgtgttttaatatttgtagacaatgttttctctcaccaggtaccaggtcatcagtacaccatctgatattttcatggtgatggaatatgtctcaggaggagagctatttgattatatctgtaagaatggaagggtaagctgttctgctttaattctgtatgtattttgtaactcccctttatcctttactagcatcaaaatgtcagcaaccaattttaagaggtctatttaataaccagttcccttagtcatatatttgtttagaatcataaactatgtagaactagaaaggatcttaaagattatctccttagcctgtttatacagatgtggatactgagcctcgcggcttatatgattgctcacagtaacgtgatttattaatgacggaattggcttgagcccccagaactcataatcctcagacttatgcttccagggtatacaaatactttgaatatgtatcttaatgtaattaatcgttacaaaatatattattattacttaaagatctaggccttgctagtcaattctagccacatttaaattgcattcattttttggtttcagaaatctgatgtacctggagtagtaaaaacaggctccacgaaggagctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggttgtaaacccatattatttgcgtgtacgaaggaagaatcctgtgacaagcacttactccaaaatgagtctacagttataccaagtggatagtagaacttatctactggatttccgtagtattgatgatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaata

SEQ ID NO: 375451 - DNA, 1648 bp, Homo sapiens
aggggctggtaggtacgaggggctgggatgcgaaggtgcaaactttcccagttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggaaatctgatgtacctggagtagtaaaaacaggctccacgaaggagctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggttgtaaacccatattatttgcgtgtacgaaggaagaatcctgtgacaagcacttactccaaaatgagtctacagttataccaagtggatagtagaacttatctactggatttccgtagtattgatgatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaata

SEQ ID NO: 375452 - DNA, 2624 bp, Homo sapiens
aaaaaaataaaagtttcttcccattcatgtatttttctaaccccattgatggtcatttaagcctgtgttcatgttttgcccttgtgcttatcagctgttatcttctcattctttcctgtctcctggaaagatgctcttctggtaatgtttggtgccccattgctgtaaaaccaacagtgatctgctagtaaaaactcttgacctccaaatgcccacatgatgtcagttagcctcactagtgagaatgcggtagtagaaagggtttttccccatcctgcttatacctgaacatatagataacaaaatttcaggaatccaaggtttcaaaagggcagtaatcttactgttgttttacagttgccagttatagagtctacaaataactatttcctgctcagcttctgctttgttatgcaggcaataacttaaagatgcttaggtttttctcctgaactggctgactcaaacttgtttcactcttacctcttctcatttgttgagtgctaggttttaaataccatccatatgctgaccacccctaaatgtacatctcttgctttaagatctcttcttacaccagacttatttgctcactgctgactttacatttccatttggatgttcgcaagacgtttaaaactcaacccggcccaaaatgaactctttattactctcccaaacctgctcttcccacagttttcaccatcttggctaacagccaatgacccagggctaaaacttaggaaccatttttaacttccctgtttctttcactttctaccatgcatttcatttcttccttcacaatcaagctaggatttgattgcttctcagttcctttattgctgtcaacctggtctcagccaccatctgtctcatgaaatcctgaagtaacctcctgtggctacctttactgttgacagttaattcttcacattgctgccatagttttacttttaatatgccagatcacatgactgcttaaaacgtacgatagcttttcatcttccttggagtaaaagccaaagccttatcatggcttgtaaaattctgtgtcttctggcctgcagttaacacctttgactctacatcctatttctctctaatattcctcgaacatgccaagcaggcttctacttggggacctttgcagttgctattccctctcccagtttcgctttcctcctagataattacataatttgttcccattcttcttttaggctcagctcaaatgttactttattagaggctttcctttagcactctgtatacaaagattccccttcatttgctttatttttcttcatagcatgttccaccacctgagatattgcttatttatttagtgtctgtttcctggttcctggaacatgaactccatgagagcagagaatttttgtttcctgcagtttttctagctcctagcctagtacctggtatactataggtgcttagtaaatatttattgaatgaatgaatatatgtgttttaatatttgtagacaatgttttctctcaccaggtaccaggtcatcagtacaccatctgatattttcatggtgatggaatatgtctcaggaggagagctatttgattatatctgtaagaatggaagggtaagctgttctgctttaattctgtatgtattttgtaactcccctttatcctttactagcatcaaaatgtcagcaaccaattttaagaggtctatttaataaccagttcccttagtcatatatttgtttagaatcataaactatgtagaactagaaaggatcttaaagattatctccttagcctgtttatacagatgtggatactgagcctcgcggcttatatgattgctcacagtaacgtgatttattaatgacggaattggcttgagcccccagaactcataatcctcagacttatgcttccagggtatacaaatactttgaatatgtatcttaatgtaattaatcgttacaaaatatattattattacttaaagatctaggccttgctagtcaattctagccacatttaaattgcattcattttttggtttcagaaatctgatgtacctggagtagtaaaaacaggctccacgaaggaggtaggaattagatataaagaatttacagctggaaggaactttgtaggacattttgaacactaccttaagttacagatacaaaaactcaacactgccctctgcccatactttttctcatacccaggttatgtggtatgcaaaagcccctttgtgggagagctgtagctagccctgaaaagagagcttttctctcaattttaagttatttacattactcattcatttgttctatatagcatgtctatttacttttatcaaaatcaaacttattaaccaagttaattttgattttactatttcttaacatgattcatttctatttcaggtactcccctttactcctgcttctccttaccaaaaaaaaaaaaaaaaaaaaaattctgcctggagaaatgggaaacaggcacaattgatatatatttttcttatctttacggtggtaggtaaatatctgggtaaaccctggggggtatcactacaagtttacccagtggattataaaatttccagcaccggttttttct

SEQ ID NO: 375453 - DNA, 847 bp, Homo sapiens
gcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatgacagaacgagactggatctcaaaatatagataaatttaaaaccccgccccccaaaaaaaca

SEQ ID NO: 375454 - DNA, 128 bp, Homo sapiens
tccttaacttcataaatagctagtatcttccagcagtagtaacagtctggataacttcttccatatccctccctctttgtttttttgagacagtgtcactttgtcacccaggctggagtgcaatggtg

SEQ ID NO: 375455 - DNA, 1149 bp, Homo sapiens
  misc_feature (1147)..(1147): n is a, c, g, or t
  misc_feature (1149)..(1149): n is a, c, g, or t
gcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagagactgcaatattataagaattttaacctctcaatttactaactaccagcattgagaacatgaagatatttgtacagtgtcgctttttgaatagtttggaaaacaggagaatttaatatttttaagaataactctttgtccttcactatactactgaaattgaaaacagaagctgaagtttgctagatttataatgaacttttaataacttttcacccaaaccatgcttatttgtgtgaatgttttgcatcttgattaactcaatgcagaaatactgtagtattttctatttttataagcttgttggcctagactgctcaaagaaatgagatttgtgtaaaaatatggctgtgagtaaggcaggagtacctaattttagatttgtcaagtttcatcttttttttaaatattaacttaatgtcaaaaattatttaaaaaatttttaaaaaaatggtgttgtctatcttaattcttttaggaataaaacaattcaggacatggagactgtggaaagttgttatttaaataaataaaaagaaatgttataactgtganan

SEQ ID NO: 375456 - DNA, 440 bp, Homo sapiens
gcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactggttttgaaaagtttcttcctaggctgtgtgcggtggctcacacctgtaattccagtactttgggaggctgaggcaggcggatcacctgaggtcaggagttcgagaccagcctggccaacatggtgaaaccctgtctccagtaaaaatacaaaaattagctgggcatggtggtgg

SEQ ID NO: 375457 - DNA, 2091 bp, Homo sapiens
gcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggttgtaaacccatattatttgcgtgtacgaaggaagaatcctgtgacaagcacttactccaaaatgagtctacagttataccaagtggatagtagaacttatctactggatttccgtagtattgatggtatgtacatcacacaaaacaacatagattagaccttgttactaacttggtattttacgccttgattcttttgaggcttcttgacttgttcctagtaattcaactgcaaaggaataaaaaatgtgatttcttgtgcctttgcaatattaacatttatgaatcttatttttcttgtaatcttatagcatattgtccttttaagattatcatcttgtaaaatccttaaagccaggtgtagtctgatcctaaggtgatagttttctgctgcatttgtttttttggtgtagttcattttgataagagacaatgttttatttagaaataaatattgactcttctgtaagcttttatttattattaaataagttttcagttaagaatgaagttatggcaattcttcattggccaattcaattgcattaagctacgctgttgagtgcaggtgtggtggcttatgcctgtaaacagcccagcactttgggaggctgaggtgggaggatggcttgagcccaggaatttgagaccagccttagcaacatactgagactctgtctttacaaaatattagatgaggttcacgtttgaatttttttcttctttataaactcaaagatagtacacacatagtagcagaaagacacaggtttgagccatgatatg

SEQ ID NO: 375458 - DNA, 1406 bp, Homo sapiens
  misc_feature (1366)..(1366): n is a, c, g, or t
tctggtggtgatagagatgataaaatatttattaagaaatgaagtcaggttcagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggttgtaaacccatattatttgcgtgtacgaaggaagaatcctgtgacaagcacttactccaaaatgagtctacagttataccaagtggatagtagaacttatctactggatttccgtagtattgatgatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaataaacagaaaactttgcttatttcttttgcagcaataagcatgcataataagtcacagccaaatgcttccatttgtaatcaagttatacataattataaccgagggctggcgttttggaatgcaatttgcacagggattggaacatgatttatagttaaaagcctaatatgcagaaatgaattaagatcattttgttgttcattgtgcagtatgtatatagcataatatacacagtgaattataggtctcaggcttacttgatttttggctattttatatttagtgtacacagggctttgaaatattaatttacataaaggccttcatatattattacgtgttatatattacgtgttataaatttattcaataaatatttgcctagaattcccaagacctttataggtgattttgttttctgggctccttaacttcataaatagctagtatcttccagcagtagtaacagtctggataacttcttccatatccctccctctttgtttttttgagacagagcgagactctggctcataaaataataataataatnaataaataaaaaataaatgtttcaggtaaacccaaaaaaa

SEQ ID NO: 375459 - DNA, 875 bp, Homo sapiens
gcagactcagttcctggagaaagatggcgacagccgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatatctgtaagaatggaaggctggatgaaaaagaaagtcggcgtctgttccaacagatcctttctggtgtggattattgtcacaggcatatggtggtccatagagatttgaaacctgaaaatgtcctgcttgatgcacacatgaatgcaaagatagctgattttggtctttcaaacatgatgtcagatggtgaatttttaagaacaagttgtggctcacccaactatgctgcaccagaagtaatttcaggaagattgtatgcaggcccagaggtagatatatggagcagtggggttattctctatgctttattatgtggaacccttccatttgatgatgaccatgtgccaactctttttaagaagatatgtgatgggatcttctatacccctcaatatttaaatccttctgtgattagccttttgaaacatatgctgcaggtggatcccatgaagagggccacaatcaaagatatcaggtaataaagcagtttggaagttatcagatctgatagtatccatgataaaagttatgtg

SEQ ID NO: 375460 - DNA, 2478 bp, Homo sapiens
ggcggtgtaaggctgggtgggggaggaaggaggtggaggacgagtaggaggggggaggaggagtggggaagtgcaaggcggctgcgcagacagcgctcctcacacagagcagcccctgacccgggcgaatgcgggcttgtgccgccgccgccgccgccgccgcccgggccaagtgacaaaggaaggaaggaagcgaggaggagccggccccgcagccgctgacagggctctgggctggggcaaagcgcggacacttcctgagcgggcaccgagcagagccgaggggcgggagggcggccgagctgttgccgcggacgggggagggggccccgagggacggaagcggttgccgggttcccatgtccccggcgaatggggaacagtcgaggagccgctgcctggggtctgaagggagctgcctccgccaccgccatggccgctggatccagccgccgcctgcagctgctcctggcgcaatgaggagaggagccgccgccaccgccaccgcccgcctctgactgactcgcgactccgccgccctctagttcgccgggcccctgccgtcagcccgccggatcccgcggcttgccggagctgcagcgtttcccgtcgcatctccgagccaccccctccctccctctccctccctcctacccatccccctttctcttcaagcgtgagactcgtgatccttccgccgcttcccttcttcattgactcggaaaaaaaatccccgaggaaaatataatattcgaagtactcattttcaatcaagtatttgcccccgtttcacgtgatacatatttttttaggatttgccctctcttttctctcctcccaggaaagggaggggaaagaattgtattttttcccaagtcctaaatcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaa

SEQ ID NO: 375461 - DNA, 1436 bp, Homo sapiens
  misc_feature (13)..(13): n is a, c, g, or t
  misc_feature (18)..(18): n is a, c, g, or t
  misc_feature (24)..(24): n is a, c, g, or t
gctcgtcagtctngtgcncggtgngaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaa

SEQ ID NO: 375462 - DNA, 2565 bp, Homo sapiens
ggcggtgtaaggctgggtgggggaggaaggaggtggaggacgagtaggaggggggaggaggagtggggaagtgcaaggcggctgcgcagacagcgctcctcacacagagcagcccctgacccgggcgaatgcgggcttgtgccgccgccgccgccgccgccgcccgggccaagtgacaaaggaaggaaggaagcgaggaggagccggccccgcagccgctgacagggctctgggctggggcaaagcgcggacacttcctgagcgggcaccgagcagagccgaggggcgggagggcggccgagctgttgccgcggacgggggagggggccccgagggacggaagcggttgccgggttcccatgtccccggcgaatggggaacagtcgaggagccgctgcctggggtctgaagggagctgcctccgccaccgccatggccgctggatccagccgccgcctgcagctgctcctggcgcaatgaggagaggagccgccgccaccgccaccgcccgcctctgactgactcgcgactccgccgccctctagttcgccgggcccctgccgtcagcccgccggatcccgcggcttgccggagctgcagcgtttcccgtcgcatctccgagccaccccctccctccctctccctccctcctacccatccccctttctcttcaagcgtgagactcgtgatccttccgccgcttcccttcttcattgactcggaaaaaaaatccccgaggaaaatataatattcgaagtactcattttcaatcaagtatttgcccccgtttcacgtgatacatatttttttaggatttgccctctcttttctctcctcccaggaaagggaggggaaagaattgtattttttcccaagtcctaaatcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaaatcctgttcattttagtgttcaatttttttattattattgttgttcttatttaaccttgtaaaatatctataaatacaaaccaaaaa

SEQ ID NO: 375463 - DNA, 2379 bp, Homo sapiens
ggcggtgtaaggctgggtgggggaggaaggaggtggaggacgagtaggaggggggaggaggagtggggaagtgcaaggcggctgcgcagacagcgctcctcacacagagcagcccctgacccgggcgaatgcgggcttgtgccgccgccgccgccgccgccgcccgggccaagtgacaaaggaaggaaggaagcgaggaggagccggccccgcagccgctgacagggctctgggctggggcaaagcgcggacacttcctgagcgggcaccgagcagagccgaggggcgggagggcggccgagctgttgccgcggacgggggagggggccccgagggacggaagcggttgccgggttcccatgtccccggcgaatggggaacagtcgaggagccgctgcctggggtctgaagggagctgcctccgccaccgccatggccgctggatccagccgccgcctgcagctgctcctggcgcaatgaggagaggagccgccgccaccgccaccgcccgcctctgactgactcgcgactccgccgccctctagttcgccgggcccctgccgtcagcccgccggatcccgcggcttgccggagctgcagcgtttcccgtcgcatctccgagccaccccctccctccctctccctccctcctacccatccccctttctcttcaagcgtgagactcgtgatccttccgccgcttcccttcttcattgactcggaaaaaaaatccccgaggaaaatataatattcgaagtactcattttcaatcaagtatttgcccccgtttcacgtgatacatatttttttaggatttgccctctcttttctctcctcccaggaaagggaggggaaagaattgtattttttcccaagtcctaaatcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaa

SEQ ID NO: 375464 - DNA, 2646 bp, Homo sapiens
ggcggtgtaaggctgggtgggggaggaaggaggtggaggacgagtaggaggggggaggaggagtggggaagtgcaaggcggctgcgcagacagcgctcctcacacagagcagcccctgacccgggcgaatgcgggcttgtgccgccgccgccgccgccgccgcccgggccaagtgacaaaggaaggaaggaagcgaggaggagccggccccgcagccgctgacagggctctgggctggggcaaagcgcggacacttcctgagcgggcaccgagcagagccgaggggcgggagggcggccgagctgttgccgcggacgggggagggggccccgagggacggaagcggttgccgggttcccatgtccccggcgaatggggaacagtcgaggagccgctgcctggggtctgaagggagctgcctccgccaccgccatggccgctggatccagccgccgcctgcagctgctcctggcgcaatgaggagaggagccgccgccaccgccaccgcccgcctctgactgactcgcgactccgccgccctctagttcgccgggcccctgccgtcagcccgccggatcccgcggcttgccggagctgcagcgtttcccgtcgcatctccgagccaccccctccctccctctccctccctcctacccatccccctttctcttcaagcgtgagactcgtgatccttccgccgcttcccttcttcattgactcggaaaaaaaatccccgaggaaaatataatattcgaagtactcattttcaatcaagtatttgcccccgtttcacgtgatacatatttttttaggatttgccctctcttttctctcctcccaggaaagggaggggaaagaattgtattttttcccaagtcctaaatcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggattcgtcaggaacaggacatttcacctcaggagtgcgggtcttccgaccccgaactccaccggaggcaattgcactgtgtagccgtctgctggagtatacaccaactgcccgactaacagtggtgtagtcgggcagttggtgtatactccagcagaggtgaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaaatcctgttcattttagtgttcaatttttttattattattgttgttcttatttaaccttgtaaaatatctataaatacaaaccaaaaa

SEQ ID NO: 375465 - DNA, 1313 bp, Homo sapiens
ggacagctgtataatctttggctatactgaactaagtgaagaaaaaatactctcagatgtgattattgcaatagatagtttttctagataaagatatctgatttttacttgaatatttttgagtatggtaatcttttttatgacccaaatttaacattattgttatcatagaagtctgtctatggtaatacagcatggaatctgtagtcagctacagataaaaggctttcacaaagtttgtttgcctttgtctgttttgtgctactataacagaataccaaagactggataatatataaacaatagaaatttacttggttcactgttctagagactggaaagtccaatgtcaaagggcccacatctggtgatggccttcgtgctgtatcatctcatattggaaggcagaaagtcaagacaaggcaagagtgagagggagccaaacttacatttctaaccagcctgctcttgaaataacaatcctgcttccactttaatgacatgagtccattcacaagggcagagccattacctaattaccatttaaacatcccacctctcaacactgttgaattgggtattaagtttccaacacatgagctttgggggacatactcaaatcatggcactgctctatttaatgagttacgtattttatttaacttgggaattccttttttcagtgaatccaatgcctgaaaacatggagactaaatttgtaaatatataggaaaagatggcaataacttgctttctttctaggtcctgggaactccaacaagggagcaaatcagagaaatgaacccaaactacacagaatttaaattccctcaaattaaggcacatccttggactaaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaa

SEQ ID NO: 375466 - DNA, 637 bp, Homo sapiens
taacaggatttttttctctttttaatattctttccaaacgtgaccagtgttgctgagtgacactcaagtaactggtggtttttcctgtgcagctggctgatcaggactgttcaggtggagttggaagctgatgcagaagcagcattattggtctgtccacggtctccagtattagcatctgacgctgctgtggcatttgtgggggttgaagcagctgcttgaatccgagcatgaggaggaataaggatggtagccagaggtggattacttgacagttcttgagtggtgaagttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaa

SEQ ID NO: 375467 - DNA, 460 bp, Homo sapiens
agatttttctctgagcatttctcatataatctttaattagcaattcacccctgtgaatccatatgcatttaactctttccattctagaaggtcctttcccaaatgcaaccatgtttctgtacatggtgggaattaagtcattattcacagggtatttgcttagattcttaaaataaaacattaattgttctttccctttttttgtactgcaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaaggtaactccaaacacttagcctcttcaccagttctaggaaagctacaccctgggtgtgaaat

SEQ ID NO: 375468 - DNA, 869 bp, Homo sapiens
aactttttttggttttgtatttttttaataaacgcactggcattggaacataataaactaaaattaaaatgtttctttactgtgcctcaccattgcacaatcaaaaaaaatttttttgcatacactgtggtgaaataatttttaaaacttggacttgctactgtgaagactgatgtttaaagtttataactgtataaacattttctatgtccccccccacaccatggatttcttataacattggatatatttttccttgctggactattctcttttggattgacttcccctgtttggattatttcactgcattatcatctttaggattcgtcaggaacaggacatttcacctcaggagtgcgggtatgtacttaatttttttttcccaaaatttcagggcaggtctataaaacttgggggaaatcttctttgagaggctaaataattactcattcttgaaatgtaatagtaaacaatgtaagtagctgtgatttctgtttttattcactgtatggcataggtttcacttatagtatatttagattgtcagcctcttgggtgattcattgacatctaggctgaagtttaggaattgtggggttttaaaattattatttctattacaagaataaatattgatgaagatccatgaaaccaaaggtctgagtgttaagcaatttcagtgagtaaggaaagaagtgacagcggaagcttctttaattaaaagacaaatttcagttcttggtggtttccttttctttagaagcaaaaataattcagatgagctagtttctagtttgccctataatttttagaagttacatgctaactcaccctgtattatggtcagaaatctgaactgtgggaga

SEQ ID NO: 375469 - DNA, 903 bp, Homo sapiens
cacgaggaatctgccatcaggatccaacaagaggttctgcggtttaatatcccgatggcagattccaaaggaatggatataggctaaacttcggaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaa

SEQ ID NO: 375470 - DNA, 2517 bp, Homo sapiens
ggcggtgtaaggctgggtgggggaggaaggaggtggaggacgagtaggaggggggaggaggagtggggaagtgcaaggcggctgcgcagacagcgctcctcacacagagcagcccctgacccgggcgaatgcgggcttgtgccgccgccgccgccgccgccgcccgggccaagtgacaaaggaaggaaggaagcgaggaggagccggccccgcagccgctgacagggctctgggctggggcaaagcgcggacacttcctgagcgggcaccgagcagagccgaggggcgggagggcggccgagctgttgccgcggacgggggagggggccccgagggacggaagcggttgccgggttcccatgtccccggcgaatggggaacagtcgaggagccgctgcctggggtctgaagggagctgcctccgccaccgccatggccgctggatccagccgccgcctgcagctgctcctggcgcaatgaggagaggagccgccgccaccgccaccgcccgcctctgactgactcgcgactccgccgccctctagttcgccgggcccctgccgtcagcccgccggatcccgcggcttgccggagctgcagcgtttcccgtcgcatctccgagccaccccctccctccctctccctccctcctacccatccccctttctcttcaagcgtgagactcgtgatccttccgccgcttcccttcttcattgactcggaaaaaaaatccccgaggaaaatataatattcgaagtactcattttcaatcaagtatttgcccccgtttcacgtgatacatatttttttaggatttgccctctcttttctctcctcccaggaaagggaggggaaagaattgtattttttcccaagtcctaaatcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggattcgtcaggaacaggacatttcacctcaggagtgcgggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaa

SEQ ID NO: 375471 - DNA, 2160 bp, Homo sapiens
ggcggtgtaaggctgggtgggggaggaaggaggtggaggacgagtaggaggggggaggaggagtggggaagtgcaaggcggctgcgcagacagcgctcctcacacagagcagcccctgacccgggcgaatgcgggcttgtgccgccgccgccgccgccgccgcccgggccaagtgacaaaggaaggaaggaagcgaggaggagccggccccgcagccgctgacagggctctgggctggggcaaagcgcggacacttcctgagcgggcaccgagcagagccgaggggcgggagggcggccgagctgttgccgcggacgggggagggggccccgagggacggaagcggttgccgggttcccatgtccccggcgaatggggaacagtcgaggagccgctgcctggggtctgaagggagctgcctccgccaccgccatggccgctggatccagccgccgcctgcagctgctcctggcgcaatgaggagaggagccgccgccaccgccaccgcccgcctctgactgactcgcgactccgccgccctctagttcgccgggcccctgccgtcagcccgccggatcccgcggcttgccggagctgcagcgtttcccgtcgcatctccgagccaccccctccctccctctccctccctcctacccatccccctttctcttcaagcgtgagactcgtgatccttccgccgcttcccttcttcattgactcggaaaaaaaatccccgaggaaaatataatattcgaagtactcattttcaatcaagtatttgcccccgtttcacgtgatacatatttttttaggatttgccctctcttttctctcctcccaggaaagggaggggaaagaattgtattttttcccaagtcctaaatcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaagtactttgaaaggaaaacttaattccactaaactcatgtcaggtgattatggtcggcttgctcttcccgtgacctcagcaagatcagaaaggaaaccttagtggccacctgcagtgaacaccttttgggctgtattttttgcctgggttcattgtgtcataagatacttctctgtcgtttaagtgttcgccttcctttgcccccatggtgtcactgtcttatgggacctcaccc

SEQ ID NO: 375472 - DNA, 601 bp, Homo sapiens
  misc_feature (36)..(36): n is a, c, g, or t
  misc_feature (39)..(39): n is a, c, g, or t
ctcccgccgcgtccctcacgtgcgcgtcctttaaanatngttgcacacaggtcctgggaactccaacaagggagcaaatcagagaaatgaacccaaactacacagaatttaaattccctcaaattaaggcacatccttggactaaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaa

SEQ ID NO: 375473 - DNA, 1638 bp, Homo sapiens
ctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggt

SEQ ID NO: 375474 - DNA, 1431 bp, Homo sapiens
ctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcagggctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggt

SEQ ID NO: 375475 - DNA, 569 bp, Homo sapiens
agggatgtacatgggaagcaatagaaccgggcgagtgggcaagcgcgtgggaaaacgacccgggggggtcaggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggt

SEQ ID NO: 375476 - DNA, 624 bp, Homo sapiens
ctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgagtgtttcaacatttgtccatgttcctgtggccacatctaacccactgcttccaactgctgcagaacactctatgggtgcatcccccacactaaccttccctctctcccagtgaagggcaccctggtactaccaacaccatgccaccacaaacaaaggatgggtgtacatgttctctcacagaccagggtgagaatttctttgtgatatatacccaggaatgaaatataagctcagagtatgatatagtt

SEQ ID NO: 375477 - DNA, 1765 bp, Homo sapiens
ctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacaggttcaggatcggggtgggcagggcgagagcttaggcttgaaggctgggaaagggacttggggaggagggtgaaggcagaatggagggtgcacgaggggtcccactgatcccttgcttttcctgtcagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggt

SEQ ID NO: 375478 - DNA, 1777 bp, Homo sapiens
ctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcagggtaagggaacgatgttgcagctcccacccgtatccccaaacaccaagaccacaggtctagcatccagggcaacagcctgccttctctcctcccaccacccccactgcccatcttctgcctcctcctctgcctgctccagaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggt

SEQ ID NO: 375479 - DNA, 1990 bp, Homo sapiens
ctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcaggtgagttgcccctgcttcatagcccccttccccttcccagaggttgagagcccgccacgcctgctgctgcttctctccttgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacaggttcaggatcggggtgggcagggcgagagcttaggcttgaaggctgggaaagggacttggggaggagggtgaaggcagaatggagggtgcacgaggggtcccactgatcccttgcttttcctgtcagacacaagctcctgaaatggtgggctcagtcattcctcccaggggtcccgaatgttgttgctggcttccgtaacccagacggttttgtctcttccctcaagacctttcctaccatgaagatgtttgaatatgtcagggtaagggaacgatgttgcagctcccacccgtatccccaaacaccaagaccacaggtctagcatccagggcaacagcctgccttctctcctcccaccacccccactgcccatcttctgcctcctcctctgcctgctccagaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggt

SEQ ID NO: 375480 - DNA, 1885 bp, Homo sapiens
ctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggtaactggattcttgatctgagcgcagacgtccttcctaacctcactgcatttggaggacctggagggagggtgggtgaagggcaaggaaagaggcaggatgagagcttggccgcggtggcgtctgaggggcctgaatgtttcaaggccagagcctggcgatcaggtggctcgcttagtcctaaaccagtcatccttctccaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggt

SEQ ID NO: 375481 - DNA, 1682 bp, Homo sapiens
ctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggt

SEQ ID NO: 375482 - DNA, 1904 bp, Homo sapiens
ctcctagaccaggtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacaggttcaggatcggggtgggcagggcgagagcttaggcttgaaggctgggaaagggacttggggaggagggtgaaggcagaatggagggtgcacgaggggtcccactgatcccttgcttttcctgtcagacacaagctcctgaaatggtgggctcagtcattcctcccaggggtcccgaatgttgttgctggcttccgtaacccagacggttttgtctcttccctcaagacctttcctaccatgaagatgtttgaatatgtcagggtaagggaacgatgttgcagctcccacccgtatccccaaacaccaagaccacaggtctagcatccagggcaacagcctgccttctctcctcccaccacccccactgcccatcttctgcctcctcctctgcctgctccagaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggt

SEQ ID NO: 375483 - DNA, 2050 bp, Homo sapiens
accggggagagagctgagagcgcctgcctactaggcgcccctccacagtgccacagtcccgccctcgtcacgtgacgaatgggccatagcgagtactgtgcacctgcgcaaagccggcccttcgtcaccccgactttcatcacgtgttggggggaagggcggcgtcacggcgtttctgagcctgcgccaaccaaatcaactggctagtcaatctcttacggctccaccctacgcctacatccgggcaaccgttggggcgcacatagttcctctaggtggcggcaaaaaccgaggtgaggcggccgtggccttagcctcgtaaaaattaaaacctgtatgtttcagcgaataatgaaaacgcagtctggatgaaagaccccatgacgcttaatcaggcatccagtacactggctgtggccccgccccgccaggcactcgctccgcctcttcgcccccattggttctaagcgccgcccggcatccctgcgattggctaggccgggcccgtcgcgtccaataggcggtggcgccggctttcccgcggctgttcgctgttccagtgggtcgtggcggtggcggcagcggcggttaggggatgtaacggtcgcccgcctccggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaataccctgctgaaggtcgtgtacgtggagaatgacatccagcacctgcaggacatgtcacact

SEQ ID NO: 375484 - DNA, 197 bp, Homo sapiens
gcacaaacagtccagtggaatgagtgctggcatgagcttctctgcacttattcttccagaaagacatcgtagtggcctccaacaaggtatcttgtagagtcattgccctctccttctcagaggacagcagctattttgtcactgttgggaaccgccatgtgaggttctggttcttggaagtctccactgagacaaag

SEQ ID NO: 375485 - DNA, 459 bp, Homo sapiens
catcttctgtggtgtggcctgcggtcggggccggatggcgggcagtaccttctgtgtgtcctactcgggcctcctctgccagttcaatgagaagagggtgctggagaagtggatcaacctgaaggtaccacctccctctctgccatcagctggacagactctttctcgtgatatgtgtctgcaggggtgctcatcagcattgaccacacaggttctgcttatgtgactagtggtgaatgacgcccactctctgagcttaaggttccacatctgtaaaatgggagtactgctgccctccccgcagagctgataaggaagtcacgtgagataacataggcaaggcagtgagcacggtgcttggtaccctgaaatgggctcaaggtgacagttgttttcccatgactatttgatctacttcacatttcttttctcctttgagcactctggctggtagaggat

SEQ ID NO: 375486 - DNA, 5552 bp, Homo sapiens
aagtgggaatttgaatcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctcaaaatggttgtatggattttatttaggtatggtagcatggttaataaaagtaaaaactgttttactcacattttttgtaaattaggattacatatagaatgccacaatttctctaggtttattcaattttcaaattattcctcattttattttaaagcattaaatagaaaagctaattggttaaattttgttatataaatcagagtcatatattctgggatttgtgttactatgcatacttttctaggatgtcaccaaattagttgtttaaaatgtttttagattactgatttatattaagatgacccacactgcaattagattatgcctagtgggaagtattatataaaaagcagaattaagctgggcacatgtgcttgtaatctcagttataagggaggctgaggtgggagaatcgagatactcagccagcctggcaatgtagcaaagactccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggtaggtttggccatttgaccattatttattatcaagttggttgtatgctaaggtaagttgacgccatagcattatacagttatcttcattgctcttgaatgatatctgttatataagcaatgtataaataaagtaaaaaggatagaatgaaaaacccattctaatgtcaccactcagagataagtaccgtatttctgtgtatccttctataaactctttacttctgtttcctttattttttaactttaataatgctactaaaagacaatacctaaaagtaactgtactaacaaagtgctaacaatgtgaaaatatatagtcccatagtcatgtccccatatttatactcccacagaagaaaaaattggaaaacaaagtctgatgtccttaatctattaacatatttaaatgatataatggttcagttttccatgaaagtaaatcattatgggaagtaaaatgttttaaccatatttttcttaatacacaaagcaggtgtcagctgttgtattctcacccttcttaagaaaaatcattacattattgatattttttaagtaacagaatagatttgaaagagataatatatctcttaataccaaaggaaaactaaaacataattctagtgtacttttctttgttccctcatgtctttttcaatctgtacactaacatacctagcaaatttgttttactttaacttgaaatatttaagaacattaaacaagacatttctttggctttggttgaatttttttgtctcaccaatagtaattgaaagatcaattatcaaagagtttgaatagctaatataaaccccaaagtcaccatacagtttttattccaaatatgttgataaaaagatatttgtttctttatccaccttatttttattacagctaaaaaccaatacaaaccaataaaacctagttaaagctattttctggtttttagttgcaattaatttcccctagggtagaaattaaagctgattaagtcacacacacatactttgttggggtgggggtggcaggtggagaggcagtgtacttgggttagctacaattaaaaacagtatttcaattcctcatttgacttattttatatatagacagggccttagtgataagatggtgtaaataatttaggatattcatgttttaaagtgaagcataaatatttattttgcaaaatgttttctagtttgaaggatgttccattattaccatttttagattaatctgtatggtcaaggaatatcagagaaacctgtaggttatttattttctgcagtgtcattttgtcaaatggttggtattataattgttcttttcttattaattttataaccagtgcataattcttacattagattttaaaaaagaattatgctataaatctttataaatgtgtacatatatttcttaaatattgcaattgcctaaatgttgtatattttaaggctgttttctcttgctcttaatgttgaggaaaactataaattgatctataatgcatctactgttaatggttttggttagtttgatattcattgtttttaaacactttccaatatggaaactttaacaccttttatacaattctctactattcaagatattctttaaaatatctcaccagaaacttacaattttatactttgtaatttttagtttctgtaatttgaggaagtgactttttttgtttgggttaagtaaaaagcctttgattgattaccagcatgagaattcaccttggtttctattttatgcatttgtaaatttttcccctaattatatggaagctattggaacttttgtattcagtgctaaatactaagtcaaggggagtatattaggtaagttttttcagtgactgtgcctttagcattcagtcattataagaaaatgatcagaacaaaatcattacattataaacatgtaattcttttatatagtgattatcatgtactgcattgttactttaaaataagctattaaactagtttttatggttcaagtaatgcaatacaaagtttcatgcttcaagtaatgcaatacaaaacataacccatttaatgatgaattacttgaatgtatattatctgtggtttaggaaaatttggattgtcttgaagagactcagttttcaagttctgattttgaccattatctcttctaattcataaacatatcccagtacctacactatgccaggtattatgctaggtgatcgtttatatgtcagcctatttcccccccttttaaagactgccagattaaccaaaaagcgtgacatttataacaatgttttataaataaataaatgtgtttatgccactaaaggt

SEQ ID NO: 375487 - DNA, 1194 bp, Homo sapiens
aagtgggaatttgaatcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaa

SEQ ID NO: 375488 - DNA, 745 bp, Homo sapiens
aagtgggaatttgaatcctgtgggccgttgaatgtggctgctcgcggtcggcgtgccccgacgtacagcgggccgggaaaagtggcactgaggctctggaacttctgcccagctctccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaaagtgagtaacatttagccttatgat

SEQ ID NO: 375489 - DNA, 794 bp, Homo sapiens
aagtgggaatttgaatcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgtctggaaattaaggaggatggaaaaataagcagctttattcaagaaggtctacaagggaagcacataagaaacatttattcttttagttgaggcaaagaagtggaggcaattatttttgaagatatcaagaaggtaggagagttaatggtaaaaacagaggttctagggcacaaggaagaaccgtgggagaaaggtgagcatgaatctaaggactacgtgagatgttaaacgtgagatattagtatcataattcctaaacttcctggtgatagtgagcttgtggtaaaaggtggtctctaaaggtccccttatggtttggaactacagattgaatatcccttatccaaaatgcttggaaccagaattttagatttgaaatttttttcagatttaggaatatttgcttaccagttgagcacctctaatctgaa

SEQ ID NO: 375490 - DNA, 701 bp, Homo sapiens
agcactaagcacatctacaatcaaggagaggggcaggctttaccttttgaaggaagaagtatgaaagtgtatcactgactgatcaagtagagctaaaaaacattcccttcaatttaaaaaatgttcccgactcttaacaccccagttgagaactactgatcttagatgtattaaagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgtctggaaattaaggaggatggaaaaataagcagctttattcaagaaggtctacaagggaagcacataagaaacatttattcttttagttgaggcaaagaagtggaggcaattatttttgaagatatcaagaaggtaggagagttaatggtaaaaacagaggttctagggcacaaggaagaaccgtgggagaaagacctcagttatttgatttaaggactaccctaaatccaggatgatctcaagatccttaacttaattacatctgcaaagaccgtatttccaa

SEQ ID NO: 375491 - DNA, 5511 bp, Homo sapiens
aagtgggaatttgaatcctgtgggccgttgaatgtggctgctcgcggtcggcgtgccccgacgtacagcgggccgggaaaagtggcactgaggctctggaacttctgcccagctctccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctcaaaatggttgtatggattttatttaggtatggtagcatggttaataaaagtaaaaactgttttactcacattttttgtaaattaggattacatatagaatgccacaatttctctaggtttattcaattttcaaattattcctcattttattttaaagcattaaatagaaaagctaattggttaaattttgttatataaatcagagtcatatattctgggatttgtgttactatgcatacttttctaggatgtcaccaaattagttgtttaaaatgtttttagattactgatttatattaagatgacccacactgcaattagattatgcctagtgggaagtattatataaaaagcagaattaagctgggcacatgtgcttgtaatctcagttataagggaggctgaggtgggagaatcgagatactcagccagcctggcaatgtagcaaagactccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggtaggtttggccatttgaccattatttattatcaagttggttgtatgctaaggtaagttgacgccatagcattatacagttatcttcattgctcttgaatgatatctgttatataagcaatgtataaataaagtaaaaaggatagaatgaaaaacccattctaatgtcaccactcagagataagtaccgtatttctgtgtatccttctataaactctttacttctgtttcctttattttttaactttaataatgctactaaaagacaatacctaaaagtaactgtactaacaaagtgctaacaatgtgaaaatatatagtcccatagtcatgtccccatatttatactcccacagaagaaaaaattggaaaacaaagtctgatgtccttaatctattaacatatttaaatgatataatggttcagttttccatgaaagtaaatcattatgggaagtaaaatgttttaaccatatttttcttaatacacaaagcaggtgtcagctgttgtattctcacccttcttaagaaaaatcattacattattgatattttttaagtaacagaatagatttgaaagagataatatatctcttaataccaaaggaaaactaaaacataattctagtgtacttttctttgttccctcatgtctttttcaatctgtacactaacatacctagcaaatttgttttactttaacttgaaatatttaagaacattaaacaagacatttctttggctttggttgaatttttttgtctcaccaatagtaattgaaagatcaattatcaaagagtttgaatagctaatataaaccccaaagtcaccatacagtttttattccaaatatgttgataaaaagatatttgtttctttatccaccttatttttattacagctaaaaaccaatacaaaccaataaaacctagttaaagctattttctggtttttagttgcaattaatttcccctagggtagaaattaaagctgattaagtcacacacacatactttgttggggtgggggtggcaggtggagaggcagtgtacttgggttagctacaattaaaaacagtatttcaattcctcatttgacttattttatatatagacagggccttagtgataagatggtgtaaataatttaggatattcatgttttaaagtgaagcataaatatttattttgcaaaatgttttctagtttgaaggatgttccattattaccatttttagattaatctgtatggtcaaggaatatcagagaaacctgtaggttatttattttctgcagtgtcattttgtcaaatggttggtattataattgttcttttcttattaattttataaccagtgcataattcttacattagattttaaaaaagaattatgctataaatctttataaatgtgtacatatatttcttaaatattgcaattgcctaaatgttgtatattttaaggctgttttctcttgctcttaatgttgaggaaaactataaattgatctataatgcatctactgttaatggttttggttagtttgatattcattgtttttaaacactttccaatatggaaactttaacaccttttatacaattctctactattcaagatattctttaaaatatctcaccagaaacttacaattttatactttgtaatttttagtttctgtaatttgaggaagtgactttttttgtttgggttaagtaaaaagcctttgattgattaccagcatgagaattcaccttggtttctattttatgcatttgtaaatttttcccctaattatatggaagctattggaacttttgtattcagtgctaaatactaagtcaaggggagtatattaggtaagttttttcagtgactgtgcctttagcattcagtcattataagaaaatgatcagaacaaaatcattacattataaacatgtaattcttttatatagtgattatcatgtactgcattgttactttaaaataagctattaaactagtttttatggttcaagtaatgcaatacaaagtttcatgcttcaagtaatgcaatacaaaacataacccatttaatgatgaattacttgaatgtatattatctgtggtttaggaaaatttggattgtcttgaagagactcagttttcaagttctgattttgaccattatctcttctaattcataaacatatcccagtacctacactatgccaggtattatgctaggtgatcgtttatatgtcagcctatttcccccccttttaaagactgccagattaaccaaaaagcgtgacatttataacaatgttttataaataaataaatgtgtttatgccactaaaggt

SEQ ID NO: 375492 - DNA, 5523 bp, Homo sapiens
agcactaagcacatctacaatcaaggagaggggcaggctttaccttttgaaggaagaagtatgaaagtgtatcactgactgatcaagtagagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctcaaaatggttgtatggattttatttaggtatggtagcatggttaataaaagtaaaaactgttttactcacattttttgtaaattaggattacatatagaatgccacaatttctctaggtttattcaattttcaaattattcctcattttattttaaagcattaaatagaaaagctaattggttaaattttgttatataaatcagagtcatatattctgggatttgtgttactatgcatacttttctaggatgtcaccaaattagttgtttaaaatgtttttagattactgatttatattaagatgacccacactgcaattagattatgcctagtgggaagtattatataaaaagcagaattaagctgggcacatgtgcttgtaatctcagttataagggaggctgaggtgggagaatcgagatactcagccagcctggcaatgtagcaaagactccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggtaggtttggccatttgaccattatttattatcaagttggttgtatgctaaggtaagttgacgccatagcattatacagttatcttcattgctcttgaatgatatctgttatataagcaatgtataaataaagtaaaaaggatagaatgaaaaacccattctaatgtcaccactcagagataagtaccgtatttctgtgtatccttctataaactctttacttctgtttcctttattttttaactttaataatgctactaaaagacaatacctaaaagtaactgtactaacaaagtgctaacaatgtgaaaatatatagtcccatagtcatgtccccatatttatactcccacagaagaaaaaattggaaaacaaagtctgatgtccttaatctattaacatatttaaatgatataatggttcagttttccatgaaagtaaatcattatgggaagtaaaatgttttaaccatatttttcttaatacacaaagcaggtgtcagctgttgtattctcacccttcttaagaaaaatcattacattattgatattttttaagtaacagaatagatttgaaagagataatatatctcttaataccaaaggaaaactaaaacataattctagtgtacttttctttgttccctcatgtctttttcaatctgtacactaacatacctagcaaatttgttttactttaacttgaaatatttaagaacattaaacaagacatttctttggctttggttgaatttttttgtctcaccaatagtaattgaaagatcaattatcaaagagtttgaatagctaatataaaccccaaagtcaccatacagtttttattccaaatatgttgataaaaagatatttgtttctttatccaccttatttttattacagctaaaaaccaatacaaaccaataaaacctagttaaagctattttctggtttttagttgcaattaatttcccctagggtagaaattaaagctgattaagtcacacacacatactttgttggggtgggggtggcaggtggagaggcagtgtacttgggttagctacaattaaaaacagtatttcaattcctcatttgacttattttatatatagacagggccttagtgataagatggtgtaaataatttaggatattcatgttttaaagtgaagcataaatatttattttgcaaaatgttttctagtttgaaggatgttccattattaccatttttagattaatctgtatggtcaaggaatatcagagaaacctgtaggttatttattttctgcagtgtcattttgtcaaatggttggtattataattgttcttttcttattaattttataaccagtgcataattcttacattagattttaaaaaagaattatgctataaatctttataaatgtgtacatatatttcttaaatattgcaattgcctaaatgttgtatattttaaggctgttttctcttgctcttaatgttgaggaaaactataaattgatctataatgcatctactgttaatggttttggttagtttgatattcattgtttttaaacactttccaatatggaaactttaacaccttttatacaattctctactattcaagatattctttaaaatatctcaccagaaacttacaattttatactttgtaatttttagtttctgtaatttgaggaagtgactttttttgtttgggttaagtaaaaagcctttgattgattaccagcatgagaattcaccttggtttctattttatgcatttgtaaatttttcccctaattatatggaagctattggaacttttgtattcagtgctaaatactaagtcaaggggagtatattaggtaagttttttcagtgactgtgcctttagcattcagtcattataagaaaatgatcagaacaaaatcattacattataaacatgtaattcttttatatagtgattatcatgtactgcattgttactttaaaataagctattaaactagtttttatggttcaagtaatgcaatacaaagtttcatgcttcaagtaatgcaatacaaaacataacccatttaatgatgaattacttgaatgtatattatctgtggtttaggaaaatttggattgtcttgaagagactcagttttcaagttctgattttgaccattatctcttctaattcataaacatatcccagtacctacactatgccaggtattatgctaggtgatcgtttatatgtcagcctatttcccccccttttaaagactgccagattaaccaaaaagcgtgacatttataacaatgttttataaataaataaatgtgtttatgccactaaaggt

SEQ ID NO: 375493 - DNA, 5495 bp, Homo sapiens
aagtgggaatttgaatcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctcaaaatggttgtatggattttatttaggtatggtagcatggttaataaaagtaaaaactgttttactcacattttttgtaaattaggattacatatagaatgccacaatttctctaggtttattcaattttcaaattattcctcattttattttaaagcattaaatagaaaagctaattggttaaattttgttatataaatcagagtcatatattctgggatttgtgttactatgcatacttttctaggatgtcaccaaattagttgtttaaaatgtttttagattactgatttatattaagatgacccacactgcaattagattatgcctagtgggaagtattatataaaaagcagaattaagctgggcacatgtgcttgtaatctcagttataagggaggctgaggtgggagaatcgagatactcagccagcctggcaatgtagcaaagactccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggtaggtttggccatttgaccattatttattatcaagttggttgtatgctaaggtaagttgacgccatagcattatacagttatcttcattgctcttgaatgatatctgttatataagcaatgtataaataaagtaaaaaggatagaatgaaaaacccattctaatgtcaccactcagagataagtaccgtatttctgtgtatccttctataaactctttacttctgtttcctttattttttaactttaataatgctactaaaagacaatacctaaaagtaactgtactaacaaagtgctaacaatgtgaaaatatatagtcccatagtcatgtccccatatttatactcccacagaagaaaaaattggaaaacaaagtctgatgtccttaatctattaacatatttaaatgatataatggttcagttttccatgaaagtaaatcattatgggaagtaaaatgttttaaccatatttttcttaatacacaaagcaggtgtcagctgttgtattctcacccttcttaagaaaaatcattacattattgatattttttaagtaacagaatagatttgaaagagataatatatctcttaataccaaaggaaaactaaaacataattctagtgtacttttctttgttccctcatgtctttttcaatctgtacactaacatacctagcaaatttgttttactttaacttgaaatatttaagaacattaaacaagacatttctttggctttggttgaatttttttgtctcaccaatagtaattgaaagatcaattatcaaagagtttgaatagctaatataaaccccaaagtcaccatacagtttttattccaaatatgttgataaaaagatatttgtttctttatccaccttatttttattacagctaaaaaccaatacaaaccaataaaacctagttaaagctattttctggtttttagttgcaattaatttcccctagggtagaaattaaagctgattaagtcacacacacatactttgttggggtgggggtggcaggtggagaggcagtgtacttgggttagctacaattaaaaacagtatttcaattcctcatttgacttattttatatatagacagggccttagtgataagatggtgtaaataatttaggatattcatgttttaaagtgaagcataaatatttattttgcaaaatgttttctagtttgaaggatgttccattattaccatttttagattaatctgtatggtcaaggaatatcagagaaacctgtaggttatttattttctgcagtgtcattttgtcaaatggttggtattataattgttcttttcttattaattttataaccagtgcataattcttacattagattttaaaaaagaattatgctataaatctttataaatgtgtacatatatttcttaaatattgcaattgcctaaatgttgtatattttaaggctgttttctcttgctcttaatgttgaggaaaactataaattgatctataatgcatctactgttaatggttttggttagtttgatattcattgtttttaaacactttccaatatggaaactttaacaccttttatacaattctctactattcaagatattctttaaaatatctcaccagaaacttacaattttatactttgtaatttttagtttctgtaatttgaggaagtgactttttttgtttgggttaagtaaaaagcctttgattgattaccagcatgagaattcaccttggtttctattttatgcatttgtaaatttttcccctaattatatggaagctattggaacttttgtattcagtgctaaatactaagtcaaggggagtatattaggtaagttttttcagtgactgtgcctttagcattcagtcattataagaaaatgatcagaacaaaatcattacattataaacatgtaattcttttatatagtgattatcatgtactgcattgttactttaaaataagctattaaactagtttttatggttcaagtaatgcaatacaaagtttcatgcttcaagtaatgcaatacaaaacataacccatttaatgatgaattacttgaatgtatattatctgtggtttaggaaaatttggattgtcttgaagagactcagttttcaagttctgattttgaccattatctcttctaattcataaacatatcccagtacctacactatgccaggtattatgctaggtgatcgtttatatgtcagcctatttcccccccttttaaagactgccagattaaccaaaaagcgtgacatttataacaatgttttataaataaataaatgtgtttatgccactaaaggt

SEQ ID NO: 375494 - DNA, 3998 bp, Homo sapiens
aagtgggaatttgaatcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctcaaaatggttgtatggattttatttaggtatggtagcatggttaataaaagtaaaaactgttttactcacattttttgtaaattaggattacatatagaatgccacaatttctctaggtttattcaattttcaaattattcctcattttattttaaagcattaaatagaaaagctaattggttaaattttgttatataaatcagagtcatatattctgggatttgtgttactatgcatacttttctaggatgtcaccaaattagttgtttaaaatgtttttagattactgatttatattaagatgacccacactgcaattagattatgcctagtgggaagtattatataaaaagcagaattaagctgggcacatgtgcttgtaatctcagttataagggaggctgaggtgggagaatcgagatactcagccagcctggcaatgtagcaaagactccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggtaggtttggccatttgaccattatttattatcaagttggttgtatgctaaggtaagttgacgccatagcattatacagttatcttcattgctcttgaatgatatctgttatataagcaatgtataaataaagtaaaaaggatagaatgaaaaacccattctaatgtcaccactcagagataagtaccgtatttctgtgtatccttctataaactctttacttctgtttcctttattttttaactttaataatgctactaaaagacaatacctaaaagtaactgtactaacaaagtgctaacaatgtgaaaatatatagtcccatagtcatgtccccatatttatactcccacagaagaaaaaattggaaaacaaagtctgatgtccttaatctattaacatatttaaatgatataatggttcagttttccatgaaagtaaatcattatgataggtaaatcattatggggaaggtaacaatgtgttttaacgccaataatttttcttaaataacacaaaggcaggggtgtcaaggcgtggtattctcacccctttcttaagaacaaatcattgcacttatcgactattttctaacggtaacacagaatagattcgagagagactagtcgttcccctaataccaagggaaacacttgcagcataactctagggttctctctatggtcctaaggtcttaagtgtggaactacattgcttagacactggtagtctcacgtggacattcgcacttacagacatctgggctgggaacacggccaagcatgagacccgg

SEQ ID NO: 375495 - DNA, 2865 bp, Homo sapiens
  misc_feature (74)..(74): n is a, c, g, or t
cccgaaaggcggccctgtatataactacccccatagggggtagggggccagggccccccccgaaagctttccanaagggtcgataggggtgttggtgccattcttttctgcaagatctttcaggtattcctgccgggtccgagttgcctttgaaaggtaaaatagcttaaagcattaatatctaaacaaatcaatctgttaatagtagtcacaaaatatgcttaatatagaaacccacattcatgtttttaagaaaaaagtgtaaattgtattccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggtaggtttggccatttgaccattatttattatcaagttggttgtatgctaaggtaagttgacgccatagcattatacagttatcttcattgctcttgaatgatatctgttatataagcaatgtataaataaagtaaaaaggatagaatgaaaaacccattctaatgtcaccactcagagataagtaccgtatttctgtgtatccttctataaactctttacttctgtttcctttattttttaactttaataatgctactaaaagacaatacctaaaagtaactgtactaacaaagtgctaacaatgtgaaaatatatagtcccatagtcatgtccccatatttatactcccacagaagaaaaaattggaaaacaaagtctgatgtccttaatctattaacatatttaaatgatataatggttcagttttccatgaaagtaaatcattatgggaagtaaaatgttttaaccatatttttcttaatacacaaagcaggtgtcagctgttgtattctcacccttcttaagaaaaatcattacattattgatattttttaagtaacagaatagatttgaaagagataatatatctcttaataccaaaggaaaactaaaacataattctagtgtacttttctttgttccctcatgtctttttcaatctgtacactaacatacctagcaaatttgttttactttaacttgaaatatttaagaacattaaacaagacatttctttggctttggttgaatttttttgtctcaccaatagtaattgaaagatcaattatcaaagagtttgaatagctaatataaaccccaaagtcaccatacagtttttattccaaatatgttgataaaaagatatttgtttctttatccaccttatttttattacagctaaaaaccaatacaaaccaataaaacctagttaaagctattttctggtttttagttgcaattaatttcccctagggtagaaattaaagctgattaagtcacacacacatactttgttggggtgggggtggcaggtggagaggcagtgtacttgggttagctacaattaaaaacagtatttcaattcctcatttgacttattttatatatagacagggccttagtgataagatggtgtaaataatttaggatattcatgttttaaagtgaagcataaatatttattttgcaaaatgttttctagtttgaaggatgttccattattaccatttttagattaatctgtatggtcaaggaatatcagagaaacctgtaggttatttattttctgcagtgtcattttgtcaaatggttggtattataattgttcttttcttattaattttataaccagtgcataattcttacattagattttaaaaaagaattatgctataaatctttataaatgtgtacatatatttcttaaatattgcaattgcctaaatgttgtatattttaaggctgttttctcttgctcttaatgttgaggaaaactataaattgatctataatgcatctactgttaatggttttggttagtttgatattcattgtttttaaacactttccaatatggaaactttaacaccttttatacaattctctactattcaagatattctttaaaatatctcaccagaaacttacaattttatactttgtaatttttagtttctgtaatttgaggaagtgactttttttgtttgggttaagtaaaaagcctttgattgattaccagcatgagaattcaccttggtttctattttatgcatttgtaaatttttcccctaattatatggaagctattggaacttttgtattcagtgctaaatactaagtcaaggggagtatattaggtaagttttttcagtgactgtgcctttagcattcagtcattataagaaaatgatcagaacaaaatcattacattataaacatgtaattcttttatatagtgattatcatgtactgcattgttactttaaaataagctattaaactagtttttatggttcaagtaatgcaatacaaagtttcatgcttcaagtaatgcaatacaaaacataacccatttaatgatgaattacttgaatgtatattatctgtggtttaggaaaatttggattgtcttgaagagactcagttttcaagttctgattttgaccattatctcttctaattcataaacatatcccagtacctacactatgccaggtattatgctaggtgatcgtttatatgtcagcctatttcccccccttttaaagactgccagattaaccaaaaagcgtgacatttataacaatgttttataaataaataaatgtgtttatgccactaaaggt

SEQ ID NO: 375496 - DNA, 786 bp, Homo sapiens
aagtgggaatttgaatcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaaagtgagtaacatttagccttatgat

SEQ ID NO: 375497 - DNA, 2574 bp, Homo sapiens
aagtgggaatttgaatcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctcaaaatggttgtatggattttatttaggtatggtagcatggttaataaaagtaaaaactgttttactc

SEQ ID NO: 375498 - DNA, 2507 bp, Homo sapiens
aagtgggaatttgaatcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctc

SEQ ID NO: 375499 - DNA, 4944 bp, Homo sapiens
aagtgggaatttgaatcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctcaaaatggttgtatggattttatttaggtatggtagcatggttaataaaagtaaaaactgttttactcacattttttgtaaattaggattacatatagaatgccacaatttctctaggtttattcaattttcaaattattcctcattttattttaaagcattaaatagaaaagctaattggttaaattttgttatataaatcagagtcatatattctgggatttgtgttactatgcatacttttctaggatgtcaccaaattagttgtttaaaatgtttttagattactgatttatattaagatgacccacactgcaattagattatgcctagtgggaagtattatataaaaagcagaattaagctgggcacatgtgcttgtaatctcagttataagggaggctgaggtgggagaatcgagatactcagccagcctggcaatgtagcaaagactccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggtaggtttggccatttgaccattatttattatcaagttggttgtatgctaaggtaagttgacgccatagcattatacagttatcttcattgctcttgaatgatatctgttatataagcaatgtataaataaagtaaaaaggatagaatgaaaaacccattctaatgtcaccactcagagataagtaccgtatttctgtgtatccttctataaactctttacttctgtttcctttattttttaactttaataatgctactaaaagacaatacctaaaagtaactgtactaacaaagtgctaacaatgtgaaaatatatagtcccatagtcatgtccccatatttatactcccacagaagaaaaaattggaaaacaaagtctgatgtccttaatctattaacatatttaaatgatataatggttcagttttccatgaaagtaaatcattatgggaagtaaaatgttttaaccatatttttcttaatacacaaagcaggtgtcagctgttgtattctcacccttcttaagaaaaatcattacattattgatattttttaagtaacagaatagatttgaaagagataatatatctcttaataccaaaggaaaactaaaacataattctagtgtacttttctttgttccctcatgtctttttcaatctgtacactaacatacctagcaaatttgttttactttaacttgaaatatttaagaacattaaacaagacatttctttggctttggttgaatttttttgtctcaccaatagtaattgaaagatcaattatcaaagagtttgaatagctaatataaaccccaaagtcaccatacagtttttattccaaatatgttgataaaaagatatttgtttctttatccaccttatttttattacagctaaaaaccaatacaaaccaataaaacctagttaaagctattttctggtttttagttgcaattaatttcccctagggtagaaattaaagctgattaagtcacacacacatactttgttggggtgggggtggcaggtggagaggcagtgtacttgggttagctacaattaaaaacagtatttcaattcctcatttgacttattttatatatagacagggccttagtgataagatggtgtaaataatttaggatattcatgttttaaagtgaagcataaatatttattttgcaaaatgttttctagtttgaaggatgttccattattaccatttttagattaatctgtatggtcaaggaatatcagagaaacctgtaggttatttattttctgcagtgtcattttgtcaaatggttggtattataattgttcttttcttattaattttataaccagtgcataattcttacattagattttaaaaaagaattatgctataaatctttataaatgtgtacatatatttcttaaatattgcaattgcctaaatgttgtatattttaaggctgttttctcttgctcttaatgttgaggaaaactataaattgatctataatgcatctactgttaatggttttggttagtttgatattcattgtttttaaacactttccaatatggaaactttaacaccttttatacaattctctactattcaagatattctttaaaatatctcaccagaaacttacaattttatactttgtaatttttagtttctgtaatttgaggaagtgactttttttgtttgggttaagtaaaaagcctttgattgattacca

SEQ ID NO: 375500 - DNA, 5636 bp, Homo sapiens
aagtgggaatttgaatcctgtgggccgttgaatgtggctgctcgcggtcggcgtgccccgacgtacagcgggccgggaaaagtggcactgaggctctggaacttctgcccagctctccttgctaaaaaacattcccttcaatttaaaaaatgttcccgactcttaacaccccagttgagaactactgatcttagatgtattaaagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctcaaaatggttgtatggattttatttaggtatggtagcatggttaataaaagtaaaaactgttttactcacattttttgtaaattaggattacatatagaatgccacaatttctctaggtttattcaattttcaaattattcctcattttattttaaagcattaaatagaaaagctaattggttaaattttgttatataaatcagagtcatatattctgggatttgtgttactatgcatacttttctaggatgtcaccaaattagttgtttaaaatgtttttagattactgatttatattaagatgacccacactgcaattagattatgcctagtgggaagtattatataaaaagcagaattaagctgggcacatgtgcttgtaatctcagttataagggaggctgaggtgggagaatcgagatactcagccagcctggcaatgtagcaaagactccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggtaggtttggccatttgaccattatttattatcaagttggttgtatgctaaggtaagttgacgccatagcattatacagttatcttcattgctcttgaatgatatctgttatataagcaatgtataaataaagtaaaaaggatagaatgaaaaacccattctaatgtcaccactcagagataagtaccgtatttctgtgtatccttctataaactctttacttctgtttcctttattttttaactttaataatgctactaaaagacaatacctaaaagtaactgtactaacaaagtgctaacaatgtgaaaatatatagtcccatagtcatgtccccatatttatactcccacagaagaaaaaattggaaaacaaagtctgatgtccttaatctattaacatatttaaatgatataatggttcagttttccatgaaagtaaatcattatgggaagtaaaatgttttaaccatatttttcttaatacacaaagcaggtgtcagctgttgtattctcacccttcttaagaaaaatcattacattattgatattttttaagtaacagaatagatttgaaagagataatatatctcttaataccaaaggaaaactaaaacataattctagtgtacttttctttgttccctcatgtctttttcaatctgtacactaacatacctagcaaatttgttttactttaacttgaaatatttaagaacattaaacaagacatttctttggctttggttgaatttttttgtctcaccaatagtaattgaaagatcaattatcaaagagtttgaatagctaatataaaccccaaagtcaccatacagtttttattccaaatatgttgataaaaagatatttgtttctttatccaccttatttttattacagctaaaaaccaatacaaaccaataaaacctagttaaagctattttctggtttttagttgcaattaatttcccctagggtagaaattaaagctgattaagtcacacacacatactttgttggggtgggggtggcaggtggagaggcagtgtacttgggttagctacaattaaaaacagtatttcaattcctcatttgacttattttatatatagacagggccttagtgataagatggtgtaaataatttaggatattcatgttttaaagtgaagcataaatatttattttgcaaaatgttttctagtttgaaggatgttccattattaccatttttagattaatctgtatggtcaaggaatatcagagaaacctgtaggttatttattttctgcagtgtcattttgtcaaatggttggtattataattgttcttttcttattaattttataaccagtgcataattcttacattagattttaaaaaagaattatgctataaatctttataaatgtgtacatatatttcttaaatattgcaattgcctaaatgttgtatattttaaggctgttttctcttgctcttaatgttgaggaaaactataaattgatctataatgcatctactgttaatggttttggttagtttgatattcattgtttttaaacactttccaatatggaaactttaacaccttttatacaattctctactattcaagatattctttaaaatatctcaccagaaacttacaattttatactttgtaatttttagtttctgtaatttgaggaagtgactttttttgtttgggttaagtaaaaagcctttgattgattaccagcatgagaattcaccttggtttctattttatgcatttgtaaatttttcccctaattatatggaagctattggaacttttgtattcagtgctaaatactaagtcaaggggagtatattaggtaagttttttcagtgactgtgcctttagcattcagtcattataagaaaatgatcagaacaaaatcattacattataaacatgtaattcttttatatagtgattatcatgtactgcattgttactttaaaataagctattaaactagtttttatggttcaagtaatgcaatacaaagtttcatgcttcaagtaatgcaatacaaaacataacccatttaatgatgaattacttgaatgtatattatctgtggtttaggaaaatttggattgtcttgaagagactcagttttcaagttctgattttgaccattatctcttctaattcataaacatatcccagtacctacactatgccaggtattatgctaggtgatcgtttatatgtcagcctatttcccccccttttaaagactgccagattaaccaaaaagcgtgacatttataacaatgttttataaataaataaatgtgtttatgccactaaaggt

SEQ ID NO: 375501 - DNA, 5084 bp, Homo sapiens
actttctgttgtcatggcactcattgtctataaggggaaatagatcactagacagtatactacattatgtgttaataaatgctatagtacagcctgggcaacatggcgaaacactgtctatataaaaaataagccagttgtggtggtatgtgcctgcagaacagctacttgggaggctgaggcagggagaatcgcttgaacccggcaggcggaggttgcagtgacctgagattgcaccactgtactccagcctgggcgaaagagcaagactgcgtctcaagaacaaaaaaagagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaaggaatattatagccacttaggctaaaaaaaggttttttttgttaaagcatactagtcaaaattggtgataatttctcattttcttgatatagatacttcataaacctcaatataaatactctcaaaatggttgtatggattttatttaggtatggtagcatggttaataaaagtaaaaactgttttactcacattttttgtaaattaggattacatatagaatgccacaatttctctaggtttattcaattttcaaattattcctcattttattttaaagcattaaatagaaaagctaattggttaaattttgttatataaatcagagtcatatattctgggatttgtgttactatgcatacttttctaggatgtcaccaaattagttgtttaaaatgtttttagattactgatttatattaagatgacccacactgcaattagattatgcctagtgggaagtattatataaaaagcagaattaagctgggcacatgtgcttgtaatctcagttataagggaggctgaggtgggagaatcgagatactcagccagcctggcaatgtagcaaagactccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggtaggtttggccatttgaccattatttattatcaagttggttgtatgctaaggtaagttgacgccatagcattatacagttatcttcattgctcttgaatgatatctgttatataagcaatgtataaataaagtaaaaaggatagaatgaaaaacccattctaatgtcaccactcagagataagtaccgtatttctgtgtatccttctataaactctttacttctgtttcctttattttttaactttaataatgctactaaaagacaatacctaaaagtaactgtactaacaaagtgctaacaatgtgaaaatatatagtcccatagtcatgtccccatatttatactcccacagaagaaaaaattggaaaacaaagtctgatgtccttaatctattaacatatttaaatgatataatggttcagttttccatgaaagtaaatcattatgggaagtaaaatgttttaaccatatttttcttaatacacaaagcaggtgtcagctgttgtattctcacccttcttaagaaaaatcattacattattgatattttttaagtaacagaatagatttgaaagagataatatatctcttaataccaaaggaaaactaaaacataattctagtgtacttttctttgttccctcatgtctttttcaatctgtacactaacatacctagcaaatttgttttactttaacttgaaatatttaagaacattaaacaagacatttctttggctttggttgaatttttttgtctcaccaatagtaattgaaagatcaattatcaaagagtttgaatagctaatataaaccccaaagtcaccatacagtttttattccaaatatgttgataaaaagatatttgtttctttatccaccttatttttattacagctaaaaaccaatacaaaccaataaaacctagttaaagctattttctggtttttagttgcaattaatttcccctagggtagaaattaaagctgattaagtcacacacacatactttgttggggtgggggtggcaggtggagaggcagtgtacttgggttagctacaattaaaaacagtatttcaattcctcatttgacttattttatatatagacagggccttagtgataagatggtgtaaataatttaggatattcatgttttaaagtgaagcataaatatttattttgcaaaatgttttctagtttgaaggatgttccattattaccatttttagattaatctgtatggtcaaggaatatcagagaaacctgtaggttatttattttctgcagtgtcattttgtcaaatggttggtattataattgttcttttcttattaattttataaccagtgcataattcttacattagattttaaaaaagaattatgctataaatctttataaatgtgtacatatatttcttaaatattgcaattgcctaaatgttgtatattttaaggctgttttctcttgctcttaatgttgaggaaaactataaattgatctataatgcatctactgttaatggttttggttagtttgatattcattgtttttaaacactttccaatatggaaactttaacaccttttatacaattctctactattcaagatattctttaaaatatctcaccagaaacttacaattttatactttgtaatttttagtttctgtaatttgaggaagtgactttttttgtttgggttaagtaaaaagcctttgattgattaccagcatgagaattcaccttggtttctattttatgcatttgtaaatttttcccctaattatatggaagctattggaacttttgtattcagtgctaaatactaagtcaaggggagtatattaggtaagttttttcagtgactgtgcctttagcattcagtcattataagaaaatgatcagaacaaaatcattacattataaacatgtaattcttttatatagtgattatcatgtactgcattgttactttaaaataagctattaaactagtttttatggttcaagtaatgcaatacaaagtttcatgcttcaagtaatgcaatacaaaacataacccatttaatgatgaattacttgaatgtatattatctgtggtttaggaaaatttggattgtcttgaagagactcagttttcaagttctgattttgaccattatctcttctaattcataaacatatcccagtacctacactatgccaggtattatgctaggtgatcgtttatatgtcagcctatttcccccccttttaaagactgccagattaaccaaaaagcgtgacatttataacaatgttttataaataaataaatgtgtttatgccactaaaggt

SEQ ID NO: 375502 - DNA, 2969 bp, Homo sapiens
  misc_feature (124)..(124): n is a, c, g, or t
gctccagacccactcgtctgataggcctccgctggtaagtgcttccacatgccgcacatgtgcctactctctttcctcgggcactttggaggcacggtgcctctacactcgctaaagggttctnccggcataattggcaacccgggttctccctcccgactgttaagccgcgccgtggattgtaaacgtccccgtaaggcgaattggtacccgcgcccccctgcgagtgtttttcttcattctctcattctttttagaaggtaaaatagcttaaagcattaatatctaaacaaatcaatctgttaatagtagtcacaaaatatgcttaatatagaaacccacattcatgtttttaagaaaaaagtgtaaattgtattccatctcaaaaaaaaaaacagaattgcacaaattttctggaatctatggacattccatgagcttaaacacttttgaggtggataacatttagttgaaaatacctaagaaagtgtgtcttctttaaagccttggctttaatcatgggaaattgttgttgttgttgttgttgtttgtatcctatgtttggtattctgtatgtctgatccataatcattttagatatttgaatgatctctgtggattggtaggtttggccatttgaccattatttattatcaagttggttgtatgctaaggtaagttgacgccatagcattatacagttatcttcattgctcttgaatgatatctgttatataagcaatgtataaataaagtaaaaaggatagaatgaaaaacccattctaatgtcaccactcagagataagtaccgtatttctgtgtatccttctataaactctttacttctgtttcctttattttttaactttaataatgctactaaaagacaatacctaaaagtaactgtactaacaaagtgctaacaatgtgaaaatatatagtcccatagtcatgtccccatatttatactcccacagaagaaaaaattggaaaacaaagtctgatgtccttaatctattaacatatttaaatgatataatggttcagttttccatgaaagtaaatcattatgggaagtaaaatgttttaaccatatttttcttaatacacaaagcaggtgtcagctgttgtattctcacccttcttaagaaaaatcattacattattgatattttttaagtaacagaatagatttgaaagagataatatatctcttaataccaaaggaaaactaaaacataattctagtgtacttttctttgttccctcatgtctttttcaatctgtacactaacatacctagcaaatttgttttactttaacttgaaatatttaagaacattaaacaagacatttctttggctttggttgaatttttttgtctcaccaatagtaattgaaagatcaattatcaaagagtttgaatagctaatataaaccccaaagtcaccatacagtttttattccaaatatgttgataaaaagatatttgtttctttatccaccttatttttattacagctaaaaaccaatacaaaccaataaaacctagttaaagctattttctggtttttagttgcaattaatttcccctagggtagaaattaaagctgattaagtcacacacacatactttgttggggtgggggtggcaggtggagaggcagtgtacttgggttagctacaattaaaaacagtatttcaattcctcatttgacttattttatatatagacagggccttagtgataagatggtgtaaataatttaggatattcatgttttaaagtgaagcataaatatttattttgcaaaatgttttctagtttgaaggatgttccattattaccatttttagattaatctgtatggtcaaggaatatcagagaaacctgtaggttatttattttctgcagtgtcattttgtcaaatggttggtattataattgttcttttcttattaattttataaccagtgcataattcttacattagattttaaaaaagaattatgctataaatctttataaatgtgtacatatatttcttaaatattgcaattgcctaaatgttgtatattttaaggctgttttctcttgctcttaatgttgaggaaaactataaattgatctataatgcatctactgttaatggttttggttagtttgatattcattgtttttaaacactttccaatatggaaactttaacaccttttatacaattctctactattcaagatattctttaaaatatctcaccagaaacttacaattttatactttgtaatttttagtttctgtaatttgaggaagtgactttttttgtttgggttaagtaaaaagcctttgattgattaccagcatgagaattcaccttggtttctattttatgcatttgtaaatttttcccctaattatatggaagctattggaacttttgtattcagtgctaaatactaagtcaaggggagtatattaggtaagttttttcagtgactgtgcctttagcattcagtcattataagaaaatgatcagaacaaaatcattacattataaacatgtaattcttttatatagtgattatcatgtactgcattgttactttaaaataagctattaaactagtttttatggttcaagtaatgcaatacaaagtttcatgcttcaagtaatgcaatacaaaacataacccatttaatgatgaattacttgaatgtatattatctgtggtttaggaaaatttggattgtcttgaagagactcagttttcaagttctgattttgaccattatctcttctaattcataaacatatcccagtacctacactatgccaggtattatgctaggtgatcgtttatatgtcagcctatttcccccccttttaaagactgccagattaaccaaaaagcgtgacatttataacaatgttttataaataaataaatgtgtttatgccactaaaggt

SEQ ID NO: 375503 - DNA, 970 bp, Homo sapiens
aagtgggaatttgaatcctgtgggccgttgaatgtggctgctcgcggtcggcgtgccccgacgtacagcgggccgggaaaagtggcactgaggctctggaacttctgcccagctctccttgtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaa

SEQ ID NO: 375504 - DNA, 174 bp, Homo sapiens
gcggccgcctactactactactactgctcgaattcaagcttctaacgatgtacggggacatgaacgttattatattgtcgaattcctactgacaacattataactgtatgggagcttaactttataaggaaatgtattttgacactggtatcttattaaagtattctgatccta

SEQ ID NO: 375505 - DNA, 2016 bp, Homo sapiens
caactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcagtgacatgtaggtaggaagcactgaaaatagtgttcccagagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttcaaaagaaatttaagttctatgagaaattccttagtcatggtgttgcgtaaatcatattttagctgcacggcattaccccacacagggtggcagaacttgaagggttactgacgtgtaaatgctggtatttgatttcctgtgtgtgttgccctggcattaagggcattttacccttgcagttttactaaaacactgaaaaatattccaagcttcatattaaccctacctgtcaacgtaacgatttcatgaacgttattatattgtcgaattcctactgacaacattataactgtatgggagcttaactttataaggaaatgtattttgacactggtatcttattaaagtattctgatcctaaaaaaaaaaaaggggggggcaaatccggggccatactccccttttaagggccc

SEQ ID NO: 375506 - DNA, 1907 bp, Homo sapiens
caactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaatgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcagtgacatgtaggtaggaagcactgaaaatagtgttcccagagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttcaaaagaaatttaagttctatgagaaattccttagtcatggtgttgcgtaaatcatattttagctgcacggcattaccccacacagggtggcagaacttgaagggttactgacgtgtaaatgctggtatttgatttcctgtgtgtgttgccctggcattaagggcattttacccttgcagttttactaaaacactgaaaaatattccaagcttcatattaaccctacctgtcaacgtaacgatttcatgaacgttattatattgtcgaattcctactgacaacattataactgtatgggagcttaactttataaggaaatgtattttgacactggtatcttattaaagtattctgatccta

SEQ ID NO: 375507 - DNA, 1962 bp, Homo sapiens
caactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcagtgacatgtaggtaggaagcactgaaaatagtgttcccagagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttctattttagctgcacggcattaccccacacagggtggcagaacttgaagggttactgacgtgtaaatgctggtatttgatttcctgtgtgtgttgccctggcattaagggcattttacccttgcagttttactaaaacactgaaaaatattccaagcttcatattaaccctacctgtcaacgtaacgatttcatgaacgttattatattgtcgaattcctactgacaacattataactgtatgggagcttaactttataaggaaatgtattttgacactggtatcttattaaagtattctgatcctaaaaaaaaaaaaggggggggcaaatccggggccatactccccttttaagggccc

SEQ ID NO: 375508 - DNA, 1602 bp, Homo sapiens
caactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcagtgacatgtaggtaggaagcactgaaaatagtgttcccagagcactttgcaactccctgggtaagagggacgacacctctggtttttcaataccaattacatggaacttttctgtaatgggtacaatgaagaagtttctaaaaacacacacaaacacacacacacaacacacacacacacacacacacacacacacacacaaatgctatcccagaaac

SEQ ID NO: 375509 - DNA, 1308 bp, Homo sapiens
caactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaactcccttcttactttctctcttatcctctttcattccacctcattctcttactctctatccctttcaaacccttacatcttcatcctctcataacctaccactcatcaccctacactttaatccatactagttcactctcctaactgttcctcttatccctttcatcttgtaccaatataattaccttatacccgctttctacttcactgtcctcctatctgtacatagttatatcactttgttcttacctttcgttgttccttactcac

SEQ ID NO: 375510 - DNA, 2138 bp, Homo sapiens
caactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcagtgacatgtaggtaggaagcactgaaaatagtgttcccagagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttcaaaagaaatttaagttctatgagaaattccttagtcatggtgttgcgtaaatcatattttagctgcacggcattaccccacacagggtggcagaacttgaagggttactgacgtgtaaatgctggtatttgatttcctgtgtgtgttgccctggcattaagggcattttacccttgcagttttactaaaacactgaaaaatattccaagcttcatattaaccctacctgtcaacgtaacgatttcatgaacgttattatattgtcgaattcctactgacaacattataactgtatgggagcttaactttataaggaaatgtattttgacactggtatcttattaaagtattctgatcctaaaaaatattccaagcttcatattaaccctacctgtccacgtaccgatttcatgaaccttatcatcttgtcgaattcctcctgacaacattataactgtatggcagcttcacttcataaggaactctacttcgacactggtatatcactacagcatttcgatcataacacaacaac

SEQ ID NO: 375511 - DNA, 1963 bp, Homo sapiens
caactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcagtgacatgtaggtaggaagcactgaaaatagtgttcccagagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttcaaaagaaatttaagttctatgagaaattccttagtcatggtgttgcgtaaatcatattttagctgcacggcattaccccacacagggtggcagaacttgaagggttactgacgtgtaaatgctggtatttgatttcctgtgtgtgttgccctggcattaagggcattttacccttgcagttttactaaaacactgaaaaatattccaagcttcatattaaccctacctgtcaacgtaacgatttcatgaacgttattatattgtcgaattcctactgacaacattataactgtatgggagcttaactttataaggaaatgtattttgacactggtatcttattaaagtattctgatccta

SEQ ID NO: 375512 - DNA, 202 bp, Homo sapiens
tcctctacaaccaagaacaaaatcagaatacctcctttaaccacttgtattaaacatagtactggaaaccttagccagagaaaatagggatgaaaaagaaataaacggcatcctaattgaaaagggagaagtaaaattgtccgtttgtacatgacatgatctcatatgttgaaatccctaaagtctccaccaaaaaccatta

SEQ ID NO: 375513 - DNA, 338 bp, Homo sapiens
aaattggttgatttttgcatctaaaaactactgaagcacatttaaaatgaagctacagatcaggttcccagtccatgcttcacactgaacttgctatttgacaatgaattttcacatgacttttcaacatctcccttttctcacatgtaaaattaagagaatagcatctttttacctgctcattgtgaggttgaagagatattatgtgggaaatcactctaaaattagaaggcactgagcatattttgggcatacttcagatgttattcatactctaatttagaagtttaaaaaattaaaatctataaatcaagaaagatgactaaagagaatcattg

SEQ ID NO: 375514 - DNA, 372 bp, Homo sapiens
acagcattccagcagcaggacaggactcaaatccacatttgtctggcagcactgttgacctccacatgagacagcttctcttagtgaagcaagatgggagaacacagcccataggtgtagatggagctgggcagtctctcctgaagacgtttagggctcagcatagtcctgcatcctccacagggcagtgcatcgaggcaggaagcctgctgcaggcaatgttttttctccagcagttctgtttctggaatgctgagtttggtgctcatgcctgtaatcccagcactttgggaggccaaggcaggaggattgcttgaggccaggagttcaagaccagcctggcaaaataatgagacccccccaatctttaca

SEQ ID NO: 375515 - DNA, 358 bp, Homo sapiens
agtggaggaaaagataactgtaaaattttattcaaagcccaatggaatgaatcccataaaaaaaataataagaggcttcagggagtcagaaaaagatttactgtagcttgggaattaggaaaactgccctcatgtgttttcctctacatttgctcatgatctcccacctccatccttggtcctattccagtttactgataaaacataattgagtcaaaaaatatatcatcagcttcagtcccgttgataaagatggtctttcttctaaatctaaaatccacccaaatctggatacaatgcaatagcttctaggaccattatgtctctgtttctcaagttggtctatttaaaaaacaaa

SEQ ID NO: 375516 - DNA, 210 bp, Homo sapiens
ttaatcccagtctcacagatacaaaacagccagtatgaaatcacttccacacatcagaatgtggtatgacacacagagacaaaagcaaaaggctggatatggctaactccatcaacctaataactcacaagtagggtttcaaaaatttggttaaaaaaaaaataaaattggccaggtgcagtggctcatgcctgtaatcccctgcactgt

SEQ ID NO: 375517 - DNA, 410 bp, Homo sapiens
caataatttattggacattttaaaataactaaaagagtatgactggattgtttgtaacacaaagaaaggataaatgctgatgtgattattatgcattgtatgcctgtatcaaaatatctcacataatccataaatagatacaccgactatacccacagaaataaaaactaggagaggaaaagaaattctaactacaacattggtaataactcattcacaatttgataataaagtaatatagaattgtaaagtacattttcactcttttaaaaaatacagcaaagagaattttaattttttaatttattagtaataacaacttgagaattgcatagtattaaggcatcaattctaggagtgtgggctgaggacccttttggggtgcctatgagggcaatactattttacag

SEQ ID NO: 375518 - DNA, 222 bp, Homo sapiens
ccgagattgcaccattgcactccagcctgggtgacaagagtgaaactctgtctcaaaaaaaaaaaaaaaaaaaaagattttggcagcaggctcacgacctttctctcccccatgttctgccaactgccagctgggtaactccagtgtccaggaagacagtcctcctgatgcactaactcttccgatctttagtttcggcctcaatgttttcacgtagcctat

SEQ ID NO: 375519 - DNA, 115 bp, Homo sapiens
ccatttttaggatgataaagtagagcctagatacagtaagtaagttgtcagagatcaccaaggtaatgagtattagaatcaggttttgttgtatttttgctcgttcgttttaaca

SEQ ID NO: 375520 - DNA, 538 bp, Homo sapiens
tgagcagaagcttttaaactcaatataatgcaatttgtccacttttgcattggttgcctgtacttgtggggtattactcaagagatctttgcccaggccaatgtcctggagagtttccccaatgttatcttttagtaacttcatggtttgaggtcttagatttaagtctaatccattttgatttgatctttgtatatggctaggaaaacatttaaggtttctttgtaaacatttttctagaaatgaaaaataggttctttgtactgcatatttataggcatgtaaagtgctttgcattttgttaaaatggctacattcaaggccagtgttcttgactgtcacggaaggtgtaaatactttagtgatcgtctgctcaaacctcccatcccaaagaaggaatactatcgtcaacagttgtgaaatgatataaacttttgcttaaaatgaacacctcattattttataaggtagcatatgccattgtcagactatttgtttaagaaaattattccaacctaaggctttaggaaaaaaaaaa

SEQ ID NO: 375521 - DNA, 457 bp, Homo sapiens
aaggcactggcaccgtggcgcctggtgcacataggcgttcatagaacgtgctgagggacctgtcactgcacttgtctcttctcaacactggggccagcagctcctggggccctgggccggggctttcccgtcagcagtgagcccctctgtaagattcgctgaggttgcctgggcaacataggccgggtcccaaagcatgttgctgctgtcggagtccaggaaagtcctggtccctgatcagggagcgagcagagcaaggcagtcctggggccctgggcccactcagcgggagccaggactccccggagagctcaccttgcagagtggctggacctgagctgggagtgacagtgcttggtgccgcttccgctcctgaatgttgctcctacgtggagctgcaaatccagcccagccttcagtctgctccgctctctggctgcggcctttcccagcttca

SEQ ID NO: 375522 - DNA, 1176 bp, Homo sapiens
cctgcgccggacgcgggctgatttccgcctccgggtggcgcttcccggtgtcgtgttctggaagcttagcggtcaccatggagctgctgggagagtacgtcgggcaggaagggaagccgcagaagctgcgggtgtcctgtgaggcgccgggtgacggcgaccctttccagggcctgttgtctggcgtggcccagatgaaggacatggtaacggaattattcgaccctctggtacagggggaagtgcagcaccgggtggcggcggctccagacgaggacttggacggtgatgatgaagatgatgcagaagatgaaaataacattgataacagaactaacttcgatggaccatctgcaaaacggccaaaaacaccgtcttaacaatagccttcatgacatttaaaagatggctgttgtatccttattgtcacactaggacatttaaggaagacttatgctctaatttggaaaaagcatttgtgttgttctcctgggacaattttgtcaaagagaaaactggtttttctgtttctagcaaagatagtaaaggcttagaaataaaatctgttttcttgagaaataaatttcagaccctggaaggaaaatagaacacttcataatgtataaaatcctctaagttggcaactgaatttttatcattgttttctatttttaaaataatcattgatttgtgtgatgtctacatcttttaacttctggttctgttataaagagtacatgtcacggttcataggcagtaacatttcagagaactgacatgaacaagtagtgaaaattgggcattaaatataaaaataacagttcttcataaacagaaggaaaataaggaaatagaaataccgacgagaaaggagagtccttgaaagagacccaaggaaaccctgaattcatacccacgtcaaatatgcacatatcctgagatgatgccactttgatgaatgtgcattagtctgatttatcatgtaccttaagagagccagatggggtatgtttttgtgctgtgatatggtatttatacaggtacaaatataaggccttaagtaaacaatctgcattgattacaatttggatatttcctctcctcctgtagccatactttgattttgctttaaaaagattattgaatccttttaaaaatatatattcctaaaatatg

SEQ ID NO: 375523 - DNA, 839 bp, Homo sapiens
cctgcgccggacgcgggctgatttccgcctccgggtggcgcttcccggtgtcgtgttctggaagcttagcggtcaccatggagctgctgggagagtacgtcgggcaggaagggaagccgcagaagctgcgggtgtcctgtgaggcgccgggtgacggcgaccctttccagggcctgttgtctggcgtggcccagatgaaggacatggtaacggaattattcgaccctctggtacagggggaagtgcagcaccgggtggcggcggctccagacgaggacttggacggtgatgatgaagatgatgcagaagatgaaaataacattgataacagaactaacttcgatggaccatctgcaaaacggccaaaaacaccgtcttaacaatagccttcatgacatttaaaagatggctgttgtatccttattgtcacactaggacatttaaggaagacttatgctctaatttggaaaaagcatttgtgttgttctcctgggacaattttgtcaaagagaaaactggtttttctgtttctagcaaagatagtaaaggcttagaaataaaatctgttttcttgagaaataaatttcagaccctggaaggaaaatagaacacttcataatgtataaaatcctctaagttggcaactgaatttttatcattgttttctatttttaaaataatcattgatttgtgtgatgtctacatcttttaacttctggttctgttataaagagtacatgtcacggttcataggcagtaacatttcagagaactgacatgaacaagtagtgaaaattgggcattaaatataaaaataacagttcttcataaacagaagg

SEQ ID NO: 375524 - DNA, 445 bp, Homo sapiens
ccctttccagggcctgttgtctggcgtggcccagatgaaggacatggtaacggaattattcgaccctctggtacagggggaagtgcagcaccgggtggcggcggctccagacgaggacttggacggtgagctctgagacggtgctgcagtgaccggaggacggggcgggcgcccaggggaaattggcttggggagcccgtgtagagtggcagacttggacaaagtgagcctcgaggaaagaagaattgcatctaaaaatttttggcgggctaggcgaagtggggctcacgcctgtaatcccagcactttgggagggcgaggcaggaggatcacttgaggtcaggagttccagaacagccagggcaacatatcgagaccccgtttctattattatttttaaaataatttaaaaaataaaaattgttggcatttatcactatattta

SEQ ID NO: 375525 - DNA, 1097 bp, Homo sapiens
cctgcgccggacgcgggctgatttccgcctccgggtggcgcttcccggtgtcgtgttctggaagcttagcggtcaccatggagctgctgggagagtacgtcgggcaggaagggaagccgcagaagctgcgggtgtcctgtgaggcgccgggtgacggcgaccctttccagggcctgttgtctggcgtggcccagatgaaggacatggtgatgatgaagatgatgcagaagatgaaaataacattgataacagaactaacttcgatggaccatctgcaaaacggccaaaaacaccgtcttaacaatagccttcatgacatttaaaagatggctgttgtatccttattgtcacactaggacatttaaggaagacttatgctctaatttggaaaaagcatttgtgttgttctcctgggacaattttgtcaaagagaaaactggtttttctgtttctagcaaagatagtaaaggcttagaaataaaatctgttttcttgagaaataaatttcagaccctggaaggaaaatagaacacttcataatgtataaaatcctctaagttggcaactgaatttttatcattgttttctatttttaaaataatcattgatttgtgtgatgtctacatcttttaacttctggttctgttataaagagtacatgtcacggttcataggcagtaacatttcagagaactgacatgaacaagtagtgaaaattgggcattaaatataaaaataacagttcttcataaacagaaggaaaataaggaaatagaaataccgacgagaaaggagagtccttgaaagagacccaaggaaaccctgaattcatacccacgtcaaatatgcacatatcctgagatgatgccactttgatgaatgtgcattagtctgatttatcatgtaccttaagagagccagatggggtatgtttttgtgctgtgatatggtatttatacaggtacaaatataaggccttaagtaaacaatctgcattgattacaatttggatatttcctctcctcctgtagccatactttgattttgctttaaaaagattattgaatccttttaaaaatatatattcctaaaatatg

SEQ ID NO: 375526 - DNA, 1121 bp, Homo sapiens
cctgcgccggacgcgggctgatttccgcctccgggtggcgcttcccggtgtcgtgttctggaagcttagcggtcaccatggagctgctgggagagtacgtcgggcaggaagggaagccgcagaagctgcgggtgtcctgtgaggcgccgggtgacggcgaccctttccagggcctgttgtctggcgtggcccagatgaaggacatggtaacggaattattcgaccctctggtacagggggaagtgcagcaccgggtggcggcggctccagacgaggacttggacggtgatgatgaagatgatgcagaagatgaaaataacattgataacagaactaacttcgatggaccatctgcaaaacggccaaaaacaccgtcttaacaatagccttcatgacatttaaaagatggctgttgtatccttattgtcacactaggacatttaaggaagacttatgctctaatttggaaaaagcatttgtgttgttctcctgggacaattttgtcaaagagaaaactggtttttctgtttctagcaaagatagtaaaggcttagaaataaaatctgttttcttgagaaataaatttcagaccctggaaggaaaatagaacacttcataatgtataaaatcctctaagttggcaactgaatttttatcattgttttctatttttaaaataatcattgatttgtgtgatgtctacatcttttaacttctggttctgttataaagagtacatgtcacggttcataggcagtaacatttcagagaactgacatgaacaagtagtgaaaattgggcattaaatataaaaataacagttcttcataaacagaaggggaaaccctgaattcatacccacgtcaaatatgcacatatcctgagatgatgccactttgatgaatgtgcattagtctgatttatcatgtaccttaagagagccagatggggtatgtttttgtgctgtgatatggtatttatacaggtacaaatataaggccttaagtaaacaatctgcattgattacaatttggatatttcctctcctcctgtagccatactttgattttgctttaaaaagattattgaatccttttaaaaatatatattcctaaaatatg

SEQ ID NO: 375527 - DNA, 1059 bp, Homo sapiens
attatttccatgtgtgagaggggagggatgcgatggctcagggagaggccgcttgggcttttctgcctcccactggaaatgtctgtgtctcggttgtccagtaattatggcccagtgttcagtcagtcagagggtttcagctggatcttctaaatacgaagccaggccaggtgtggtggctcacacatgtaatcccaacactttgggaggccaaggtcggtggatcacttgaggccaggagtttgagaccagcttggccaacatggtgaaaccctatctgtactaaaaatacaaaaattaggtgggtgtggtggtgtgcacctgtagttgtagctactcgggaggctgagacacaagtatcacttgaacccaggagatgaggttgcagtgagcccacatcatgccactgcactccggcctgggcgacagagtgaggctctgtctcaaaaaacaacaccaacaaaaacaacaaaccacaacgaacaaacaacaaacagcaccgagaggcgcagcagcaaaagaatcgtccacaggaggcgcccccccatatggggtcaaccaaggcatagaacaacagcaggaagcccatcaagacaacggaggcgaacacacgccagagaccacgccgacgtagagcacaacaagcaggagcgaggcaacgccgtgaccaagagaaagataagcagagcaccaccaacaggggggaggacacaacaaggaacaagacacacaccaagagcgaaagacgcgcgccaggcacaagcaaaaccacgagcacgcgtacaggggacaagcagacggacaatgggagccggcgcacacgctcgccacgcaaacagcagccctcagggcacagattcaacgggagaacgagaaggaagcaagacggaacagagcccagaaacgcacaggagaagaaccaagagagcacagcacgaggagcagcgacgacacacacacgcagggaaacgggagcaacgcgcaaaggagcggcacgcggcgagcaaccagagcgagcgacacgcacacacgacgagcgagggagagaaccgacgcact

SEQ ID NO: 375528 - DNA, 6496 bp, Homo sapiens
  misc_feature (10)..(10): n is a, c, g, or t
  misc_feature (86)..(86): n is a, c, g, or t
  misc_feature (728)..(728): n is a, c, g, or t
  misc_feature (770)..(770): n is a, c, g, or t
  misc_feature (853)..(853): n is a, c, g, or t
  misc_feature (1085)..(1085): n is a, c, g, or t
  misc_feature (1091)..(1091): n is a, c, g, or t
  misc_feature (1137)..(1137): n is a, c, g, or t
  misc_feature (1457)..(1457): n is a, c, g, or t
gaattccttnaacctgggaggcaggggctgcagtgagcagagatcgcaccactgcacttcagcctgggcgacagagcaagactctntcttaaaaacaaacaaacaaacaaaaacacacaaaaaaaatttaaattggagaatgagaatatacaagcatctccattccacagccataaactgattgataaattaaactgtataaatgaatagcaaatggttacatcatgagtcatgaatacagatgatttattcacaatagccatgtaatatgtgggatttaaaaggaactggtacatttatttctactgataccaaaatcttttaaatctatcattgattgaggaaaacaacttggttagacttagtgtccaatatggtagtatttatgaaaaatattaaatcaagaatagaaaaattgcatataaagccagagatagacctcaaattttttttttttttttttagatggagtcttgctcttgtcacccaggttctggagtgcaatggcgtgatcatggctcactgcaacttccgccccctgggttcaagtaattctcctgcctcagccggtatagctgggattataggcatgcgccactacactcagctaacttttgtatttttagtagagacagggtttcaccatgttggccaggctggtctcgaactcctgaccttgtgatctgcccacctcggcctcccaaagtgctgggattataggcgtgacnactgcactggccgacctcaaatttttatgcctggagattagnaaagggcatggaataatgaaggggaacttttattttattttgtttttgagatagggtctcagtctgttgtccaggctggggcncagtggtgcaatcatggctcactgcagcctcaacctcgaggtctcaagtgatcctcccacctcagcctcctaagtagctgggaccacaagcacatggcaccacacctggctaatttttaaattttctgtagagatggggtctcactatgttgtccaagctggtctcaaactcctgggctcaagtgatcctcctgcctcagcctctgaaggtgttgggattacaggcgtgacnaccacncctggcctaattttattcattaaatatgttagaattaagtgttttnccttgagacctgtgagttttttcagtgaaaaaatattcaaaaggtttgtcagtatgtccataaaaaagaagataggaggggagggacaggacccaggagggcagcctacagcctgctctccccgttctgtcctggggcggagtctgtactgcgagttgagcttttcccaaggcgcatgttactcctggagccaagcctagcagtgcagccgcacagtcagggtggggtgggccaggcggagaagcaggctgcagagggggcagggtggtggcctggggatctcagggaagggctatgggagcacggcggtgtcctcagtnctggggcttcaggggccttggtaccgcgagttgactcttgggggcaggaggtcactccatgcaggggcagcaggtgctggccaccacattgtccagcaaggtggcagcagaggcctcctaggtcccttcctaggaaaggagcctgggctgccctgatgagtctcctgtctctctctctcccgcaggatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtacccactctactcccactcgcccctgctgcagccgctgccgcccagcaaggcggccgaggagctccaccgggtggacttggtgctgcccgaggacaccaccgagtatttcgtgcgcaccaaggccggcggcgtctgcttcaaacccggcaccaagatgctggagaggccgcccccgggacggccggaggagaagcctgagggggccaacggctcctcggcccggcggccaccccggtacctcctgagcgcccgggagcgcacggggggccgaggcgcccggcgcaagtgggtggagtgcgtgtgcctgcccggctggcacggacccagctgcggcgtgcccactgtggtgcagtactccaacctgcccaccaaggagcggctggtgcccagggaggtgccgcgccgcgtcatcaacgccatcaacgtcaaccacgagttcgacctgctggacgtgcgcttccacgagctgggcgacgtggtggacgcctttgtggtgtgcgagtccaacttcacggcttatggggagccgcggccgctcaagttccgggagatgctgaccaatggcaccttcgagtacatccgccacaaggtgctctatgtcttcctggaccacttcccgcccggcggccggcaggacggctggatcgccgacgactacctgcgcaccttcctcacccaggacggcgtctcgcggctgcgcaacctgcggcccgacgacgtcttcatcattgacgatgcggacgagatcccggcccgtgacggcgtccttttcctcaagctctacgatggctggaccgagcccttcgccttccacatgcgcaagtcgctctacggcttcttctggaagcagccgggcaccctggaggtggtgtcaggctgcacggtggacatgctgcaggcagtgtatgggctggacggcatccgcctgcgccgccgccagtactacaccatgcccaacttcagacagtatgagaaccgcaccggccacatcctggtgcagtggtcgctgggcagccccctgcacttcgccggctggcactgctcctggtgcttcacgcccgagggcatctacttcaagctcgtgtccgcccagaatggcgacttcccacgctggggtgactacgaggacaagcgggacctgaactacatccgcggcctgatccgcaccgggggctggttcgacggcacgcagcaggagtacccgcctgcagaccccagcgagcacatgtatgcgcccaagtacctgctgaagaactacgaccggttccactacctgctggacaacccctaccaggagcccaggagcacggcggcgggcgggtggcgccacaggggtcccgagggaaggccgcccgcccggggcaaactggacgaggcggaagtctagagctgcatgatctgatagggtttgtgacagggcgggggtggcggcggcccctagcgctatctccctgcctcctgccggctccttggttcttgaggggaccaggagtgggtggggagtgggggtgggggtagggtttccctactgaagcccttgtgaatcaagggtcaggcctttgagctcagaaaatatccctcctgttgggagagggcgcaggccgtgacgtctgggtggcccttatgactgccaagactgctgtggccaggaggtgccactggagtgtgcgtggtggtccctgggtagcgggggagggtaggcaggattggggaagagagcctgcaggatctcaccaggcagcctctggggggtggccaggccggaaaaagcccaccatttggcatccctgggccttgggctccgtgtgggagaccggcctgccaggaggacccagggctctgtaagtagatgcatttgggtccaggaggaagcgtggacacctcgtagggaagagatgaaaaagccacatcctaccaagaggaggtgctgagggatgctttgcagtgtagtcagaagtgctgggccagatggagacagaactccaccccctgccgcaaaggacaggacctggctgccctgggatgctggtgcctgagtctgtctctgtgcacccctcaggctgtcgtgagccaacacaggggcctggagaaccctgaggagctttccttttggttctaaacccggcgttgacgttccttctccctttcacattgctgtcttgtggactgtgcactcagtccttgcaaggccaagagtccagttgtaggtgtggccttgagggggaagtggggaggagaagactgacatgagtcctctgcacggatccgtctctccctccccatcaccccttccttctgacacccagtcccagctgtccactgtcccaggtgcagtcactgttgtgcccttccttggggcaggctggctgggggccagaaaggggccatgaggctgtcttgggcccaaaaagggacaataaggccagttgtatgcttcctgttcctcatagcttgccttggtggggatgtctttgttggagttgattctgagctgctgtgattaggagaccctgaaatacagtggtttaagcaagatggaagcttgtttctaattagtctagattgagatggcccagagctggtagggcagctctgcgtttcttcatacgcaccttccaattctgggtacacagcggctgctccagcgcccaccctcctgtgtgcatccaagcctgggggaagcagaaatagacaagagggcacacccactttttgctaaaggcatgagccagaattggcaggctcacctctgctggcctctcattggctgggactcagtcacatggccacaagcagctgctagggaacctgggaagtgtagtcttcagcggggccgccatgtgcctggcctcaccttgggagttatcttattgatggaggagaagagaatggatatgggggaccagtagcatctctgggagagggggagggagcagcaataactcagtcgtcggatccagctctcattgtcagagtttccggaacagcttgctcctgtttccctcactgtgcagcccagggctgggggcagtgaggagcttgcagctctgtgggaaggggaaacaccccctcccctcggcccctcagacgctacccaatgatgccggtttgcagagttggcctgtggaatggctcatgtttgtgcgtgtgtgtgtgtatatttatgggcatgggtgcatgcttggtgtgtatttgtacatgtctgtattgctgtgtccctgtaaatacatgcttgtgtatggatggaagaggccaggcccaggcctggcctcttcctcgggcctgtggccacacctcctgcagctccccaaaatgactgaggcagaaagcccttggggagcctagaaagcaaagctaaaggggatgcagggtctgtctgtctgtctgtctttcagtctgaggaatgagaatcctgacctgagggctgtgcagctgagagcccactacctccccagcccctctcggccccagcccattcatcccacctgtcccctcccccccacctccagtggggctttctccagatgtcttatggttgggggtttcctgatgggccaggagaggagggcatcttcttgcgacagcactgtctgggttaagtgcccagtgagggcatggtgtggggagctggcctcagaggagccgctggtgggcaagcgtgaagtgggctgaggggctctgagccactttgctcccatctaggggactgccccccatggaactcctttgaagtcacagcagccttcctttctgtttgctcttggggctgagaggtggctcaaacactcggggtccctatggctctgggtcaatctaggccaggctgcaccccatggacagggagtctcagggctcctgatcatgcccaggccctggcctggggcctccctccttggcagctttcccacccccacgcccctggcatcctcagttgctatgggatgcccctccagggcaccagctcagggctaagcgaaggaagataggagcagctcagagctgccaggctctgccttcctcacagacctggtggggcaggtcctgttcacagcagcaggagtgaaggcctggccatcggtggagagggcagctgtcagagggctgggggccagggcacaggattgaagagtttcacatatcatcacagcatacactgggaatttggtgggggcagaagaacccagggccactccctcaatatgaagggaaaccaagctgaatgtgaccaccggcacactgctgccatgtcccatgtccacctttctccccgggaataactggccctgagacccctagacccaaggaggcctgtccatgccaagcatccgggaagcatggctggccttatccacccatgggtcacgtcggttcccaggggcagcatgggagatctttgggggcaacagggagagtctgggtggggagacgggacttgtccaagcagaaggcaggaccctgggaaatgcataatgtaaggacatcaataatagtattattttttttgtaagggaaaatcaatatgtacattctgaaatcattttctctgtaaatggttggatttcatttcacccttaaagggatgcttaaaggagaagataatattaataataaaaacagctacaaagtctgaaaaaaaaaa

SEQ ID NO: 375529 - DNA, 5196 bp, Homo sapiens
gagcggccgcgccgggtccccgggacggggtggaagtgggggtggggggaggggatcggggccgggccggggccgcgctgcctgcgatgccgggcgcccgccgcagccgctgccgccggagcccgggatggggcgagaggctgcggcggacgccagcatctccccgccggggaccccgggggccgcggagccgccgccgccgctgctgccgccgttgctgagacccagcgggcgatggatggagtcttgctcttgtcacccaggttctggagtgcaatggcgtgatcatggctcactgcaacttccgccccctgggttcaagtaattctcctgcctcagccggatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtacccactctactcccactcgcccctgctgcagccgctgccgcccagcaaggcggccgaggagctccaccgggtggacttggtgctgcccgaggacaccaccgagtatttcgtgcgcaccaaggccggcggcgtctgcttcaaacccggcaccaagatgctggagaggccgcccccgggacggccggaggagaagcctgagggggccaacggctcctcggcccggcggccaccccggtacctcctgagcgcccgggagcgcacggggggccgaggcgcccggcgcaagtgggtggagtgcgtgtgcctgcccggctggcacggacccagctgcggcgtgcccactgtggtgcagtactccaacctgcccaccaaggagcggctggtgcccagggaggtgccgcgccgcgtcatcaacgccatcaacgtcaaccacgagttcgacctgctggacgtgcgcttccacgagctgggcgacgtggtggacgcctttgtggtgtgcgagtccaacttcacggcttatggggagccgcggccgctcaagttccgggagatgctgaccaatggcaccttcgagtacatccgccacaaggtgctctatgtcttcctggaccacttcccgcccggcggccggcaggacggctggatcgccgacgactacctgcgcaccttcctcacccaggacggcgtctcgcggctgcgcaacctgcggcccgacgacgtcttcatcattgacgatgcggacgagatcccggcccgtgacggcgtccttttcctcaagctctacgatggctggaccgagcccttcgccttccacatgcgcaagtcgctctacggcttcttctggaagcagccgggcaccctggaggtggtgtcaggctgcacggtggacatgctgcaggcagtgtatgggctggacggcatccgcctgcgccgccgccagtactacaccatgcccaacttcagacagtatgagaaccgcaccggccacatcctggtgcagtggtcgctgggcagccccctgcacttcgccggctggcactgctcctggtgcttcacgcccgagggcatctacttcaagctcgtgtccgcccagaatggcgacttcccacgctggggtgactacgaggacaagcgggacctgaactacatccgcggcctgatccgcaccgggggctggttcgacggcacgcagcaggagtacccgcctgcagaccccagcgagcacatgtatgcgcccaagtacctgctgaagaactacgaccggttccactacctgctggacaacccctaccaggagcccaggagcacggcggcgggcgggtggcgccacaggggtcccgagggaaggccgcccgcccggggcaaactggacgaggcggaagtctagagctgcatgatctgatagggtttgtgacagggcgggggtggcggcggcccctagcgctatctccctgcctcctgccggctccttggttcttgaggggaccaggagtgggtggggagtgggggtgggggtagggtttccctactgaagcccttgtgaatcaagggtcaggcctttgagctcagaaaatatccctcctgttgggagagggcgcaggccgtgacgtctgggtggcccttatgactgccaagactgctgtggccaggaggtgccactggagtgtgcgtggtggtccctgggtagcgggggagggtaggcaggattggggaagagagcctgcaggatctcaccaggcagcctctggggggtggccaggccggaaaaagcccaccatttggcatccctgggccttgggctccgtgtgggagaccggcctgccaggaggacccagggctctgtaagtagatgcatttgggtccaggaggaagcgtggacacctcgtagggaagagatgaaaaagccacatcctaccaagaggaggtgctgagggatgctttgcagtgtagtcagaagtgctgggccagatggagacagaactccaccccctgccgcaaaggacaggacctggctgccctgggatgctggtgcctgagtctgtctctgtgcacccctcaggctgtcgtgagccaacacaggggcctggagaaccctgaggagctttccttttggttctaaacccggcgttgacgttccttctccctttcacattgctgtcttgtggactgtgcactcagtccttgcaaggccaagagtccagttgtaggtgtggccttgagggggaagtggggaggagaagactgacatgagtcctctgcacggatccgtctctccctccccatcaccccttccttctgacacccagtcccagctgtccactgtcccaggtgcagtcactgttgtgcccttccttggggcaggctggctgggggccagaaaggggccatgaggctgtcttgggcccaaaaagggacaataaggccagttgtatgcttcctgttcctcatagcttgccttggtggggatgtctttgttggagttgattctgagctgctgtgattaggagaccctgaaatacagtggtttaagcaagatggaagcttgtttctaattagtctagattgagatggcccagagctggtagggcagctctgcgtttcttcatacgcaccttccaattctgggtacacagcggctgctccagcgcccaccctcctgtgtgcatccaagcctgggggaagcagaaatagacaagagggcacacccactttttgctaaaggcatgagccagaattggcaggctcacctctgctggcctctcattggctgggactcagtcacatggccacaagcagctgctagggaacctgggaagtgtagtcttcagcggggccgccatgtgcctggcctcaccttgggagttatcttattgatggaggagaagagaatggatatgggggaccagtagcatctctgggagagggggagggagcagcaataactcagtcgtcggatccagctctcattgtcagagtttccggaacagcttgctcctgtttccctcactgtgcagcccagggctgggggcagtgaggagcttgcagctctgtgggaaggggaaacaccccctcccctcggcccctcagacgctacccaatgatgccggtttgcagagttggcctgtggaatggctcatgtttgtgcgtgtgtgtgtgtatatttatgggcatgggtgcatgcttggtgtgtatttgtacatgtctgtattgctgtgtccctgtaaatacatgcttgtgtatggatggaagaggccaggcccaggcctggcctcttcctcgggcctgtggccacacctcctgcagctccccaaaatgactgaggcagaaagcccttggggagcctagaaagcaaagctaaaggggatgcagggtctgtctgtctgtctgtctttcagtctgaggaatgagaatcctgacctgagggctgtgcagctgagagcccactacctccccagcccctctcggccccagcccattcatcccacctgtcccctcccccccacctccagtggggctttctccagatgtcttatggttgggggtttcctgatgggccaggagaggagggcatcttcttgcgacagcactgtctgggttaagtgcccagtgagggcatggtgtggggagctggcctcagaggagccgctggtgggcaagcgtgaagtgggctgaggggctctgagccactttgctcccatctaggggactgccccccatggaactcctttgaagtcacagcagccttcctttctgtttgctcttggggctgagaggtggctcaaacactcggggtccctatggctctgggtcaatctaggccaggctgcaccccatggacagggagtctcagggctcctgatcatgcccaggccctggcctggggcctccctccttggcagctttcccacccccacgcccctggcatcctcagttgctatgggatgcccctccagggcaccagctcagggctaagcgaaggaagataggagcagctcagagctgccaggctctgccttcctcacagacctggtggggcaggtcctgttcacagcagcaggagtgaaggcctggccatcggtggagagggcagctgtcagagggctgggggccagggcacaggattgaagagtttcacatatcatcacagcatacactgggaatttggtgggggcagaagaacccagggccactccctcaatatgaagggaaaccaagctgaatgtgaccaccggcacactgctgccatgtcccatgtccacctttctccccgggaataactggccctgagacccctagacccaaggaggcctgtccatgccaagcatccgggaagcatggctggccttatccacccatgggtcacgtcggttcccaggggcagcatgggagatctttgggggcaacagggagagtctgggtggggagacgggacttgtccaagcagaaggcaggaccctgggaaatgcataatgtaaggacatcaataatagtattattttttttgtaagggaaaatcaatatgtacattctgaaatcattttctctgtaaatggttggatttcatttcacccttaaagggatgcttaaaggagaagataatattaataataaaaacagctacaaagtctgaaaaaaaaaa

SEQ ID NO: 375530 - DNA, 5092 bp, Homo sapiens
gagcggccgcgccgggtccccgggacggggtggaagtgggggtggggggaggggatcggggccgggccggggccgcgctgcctgcgatgccgggcgcccgccgcagccgctgccgccggagcccgggatggggcgagaggctgcggcggacgccagcatctccccgccggggaccccgggggccgcggagccgccgccgccgctgctgccgccgttgctgagacccagcgggcgatgggatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtacccactctactcccactcgcccctgctgcagccgctgccgcccagcaaggcggccgaggagctccaccgggtggacttggtgctgcccgaggacaccaccgagtatttcgtgcgcaccaaggccggcggcgtctgcttcaaacccggcaccaagatgctggagaggccgcccccgggacggccggaggagaagcctgagggggccaacggctcctcggcccggcggccaccccggtacctcctgagcgcccgggagcgcacggggggccgaggcgcccggcgcaagtgggtggagtgcgtgtgcctgcccggctggcacggacccagctgcggcgtgcccactgtggtgcagtactccaacctgcccaccaaggagcggctggtgcccagggaggtgccgcgccgcgtcatcaacgccatcaacgtcaaccacgagttcgacctgctggacgtgcgcttccacgagctgggcgacgtggtggacgcctttgtggtgtgcgagtccaacttcacggcttatggggagccgcggccgctcaagttccgggagatgctgaccaatggcaccttcgagtacatccgccacaaggtgctctatgtcttcctggaccacttcccgcccggcggccggcaggacggctggatcgccgacgactacctgcgcaccttcctcacccaggacggcgtctcgcggctgcgcaacctgcggcccgacgacgtcttcatcattgacgatgcggacgagatcccggcccgtgacggcgtccttttcctcaagctctacgatggctggaccgagcccttcgccttccacatgcgcaagtcgctctacggcttcttctggaagcagccgggcaccctggaggtggtgtcaggctgcacggtggacatgctgcaggcagtgtatgggctggacggcatccgcctgcgccgccgccagtactacaccatgcccaacttcagacagtatgagaaccgcaccggccacatcctggtgcagtggtcgctgggcagccccctgcacttcgccggctggcactgctcctggtgcttcacgcccgagggcatctacttcaagctcgtgtccgcccagaatggcgacttcccacgctggggtgactacgaggacaagcgggacctgaactacatccgcggcctgatccgcaccgggggctggttcgacggcacgcagcaggagtacccgcctgcagaccccagcgagcacatgtatgcgcccaagtacctgctgaagaactacgaccggttccactacctgctggacaacccctaccaggagcccaggagcacggcggcgggcgggtggcgccacaggggtcccgagggaaggccgcccgcccggggcaaactggacgaggcggaagtctagagctgcatgatctgatagggtttgtgacagggcgggggtggcggcggcccctagcgctatctccctgcctcctgccggctccttggttcttgaggggaccaggagtgggtggggagtgggggtgggggtagggtttccctactgaagcccttgtgaatcaagggtcaggcctttgagctcagaaaatatccctcctgttgggagagggcgcaggccgtgacgtctgggtggcccttatgactgccaagactgctgtggccaggaggtgccactggagtgtgcgtggtggtccctgggtagcgggggagggtaggcaggattggggaagagagcctgcaggatctcaccaggcagcctctggggggtggccaggccggaaaaagcccaccatttggcatccctgggccttgggctccgtgtgggagaccggcctgccaggaggacccagggctctgtaagtagatgcatttgggtccaggaggaagcgtggacacctcgtagggaagagatgaaaaagccacatcctaccaagaggaggtgctgagggatgctttgcagtgtagtcagaagtgctgggccagatggagacagaactccaccccctgccgcaaaggacaggacctggctgccctgggatgctggtgcctgagtctgtctctgtgcacccctcaggctgtcgtgagccaacacaggggcctggagaaccctgaggagctttccttttggttctaaacccggcgttgacgttccttctccctttcacattgctgtcttgtggactgtgcactcagtccttgcaaggccaagagtccagttgtaggtgtggccttgagggggaagtggggaggagaagactgacatgagtcctctgcacggatccgtctctccctccccatcaccccttccttctgacacccagtcccagctgtccactgtcccaggtgcagtcactgttgtgcccttccttggggcaggctggctgggggccagaaaggggccatgaggctgtcttgggcccaaaaagggacaataaggccagttgtatgcttcctgttcctcatagcttgccttggtggggatgtctttgttggagttgattctgagctgctgtgattaggagaccctgaaatacagtggtttaagcaagatggaagcttgtttctaattagtctagattgagatggcccagagctggtagggcagctctgcgtttcttcatacgcaccttccaattctgggtacacagcggctgctccagcgcccaccctcctgtgtgcatccaagcctgggggaagcagaaatagacaagagggcacacccactttttgctaaaggcatgagccagaattggcaggctcacctctgctggcctctcattggctgggactcagtcacatggccacaagcagctgctagggaacctgggaagtgtagtcttcagcggggccgccatgtgcctggcctcaccttgggagttatcttattgatggaggagaagagaatggatatgggggaccagtagcatctctgggagagggggagggagcagcaataactcagtcgtcggatccagctctcattgtcagagtttccggaacagcttgctcctgtttccctcactgtgcagcccagggctgggggcagtgaggagcttgcagctctgtgggaaggggaaacaccccctcccctcggcccctcagacgctacccaatgatgccggtttgcagagttggcctgtggaatggctcatgtttgtgcgtgtgtgtgtgtatatttatgggcatgggtgcatgcttggtgtgtatttgtacatgtctgtattgctgtgtccctgtaaatacatgcttgtgtatggatggaagaggccaggcccaggcctggcctcttcctcgggcctgtggccacacctcctgcagctccccaaaatgactgaggcagaaagcccttggggagcctagaaagcaaagctaaaggggatgcagggtctgtctgtctgtctgtctttcagtctgaggaatgagaatcctgacctgagggctgtgcagctgagagcccactacctccccagcccctctcggccccagcccattcatcccacctgtcccctcccccccacctccagtggggctttctccagatgtcttatggttgggggtttcctgatgggccaggagaggagggcatcttcttgcgacagcactgtctgggttaagtgcccagtgagggcatggtgtggggagctggcctcagaggagccgctggtgggcaagcgtgaagtgggctgaggggctctgagccactttgctcccatctaggggactgccccccatggaactcctttgaagtcacagcagccttcctttctgtttgctcttggggctgagaggtggctcaaacactcggggtccctatggctctgggtcaatctaggccaggctgcaccccatggacagggagtctcagggctcctgatcatgcccaggccctggcctggggcctccctccttggcagctttcccacccccacgcccctggcatcctcagttgctatgggatgcccctccagggcaccagctcagggctaagcgaaggaagataggagcagctcagagctgccaggctctgccttcctcacagacctggtggggcaggtcctgttcacagcagcaggagtgaaggcctggccatcggtggagagggcagctgtcagagggctgggggccagggcacaggattgaagagtttcacatatcatcacagcatacactgggaatttggtgggggcagaagaacccagggccactccctcaatatgaagggaaaccaagctgaatgtgaccaccggcacactgctgccatgtcccatgtccacctttctccccgggaataactggccctgagacccctagacccaaggaggcctgtccatgccaagcatccgggaagcatggctggccttatccacccatgggtcacgtcggttcccaggggcagcatgggagatctttgggggcaacagggagagtctgggtggggagacgggacttgtccaagcagaaggcaggaccctgggaaatgcataatgtaaggacatcaataatagtattattttttttgtaagggaaaatcaatatgtacattctgaaatcattttctctgtaaatggttggatttcatttcacccttaaagggatgcttaaaggagaagataatattaataataaaaacagctacaaagtctgaaaaaaaaaa

SEQ ID NO: 375531 - DNA, 259 bp, Homo sapiens
agtggtagattctgggacctcatgcatttaacatcaatgcaggctttctccggggatttatcctgttggagctcacctgtgacaacagtaaatccagcaagttaccagatggactatgttgtccaagacattgagactgtgagtgaaactttgcaatctaatacctggcatttttgaccactaagatcaatgaaaggcacaccattcaatgaccactaagatcaatgaaaggcactcattcaatatgccaagaccaagc

SEQ ID NO: 375532 - DNA, 690 bp, Homo sapiens
tgaagctccttggtcaagagcaatttagaggccaggattgcatcactaacaaattccttggatggtttgtgcttacattacttaacttccttagtttataaacgtatatacacttactgaccttatccttttgttgagaaaaatgatgcgagaaaaagtaatatccacaacatcaaaataatggttgtgtaatggttttaaagagcacatcacagagagtgttcttttcaaatcactgtgaaattctctaaagcatatccaagcaaagttttgactgtcaacattctctttccttaagagtcatgattcccaaactgctccaatagaacaccagaccaaggtgccggatctacagaatcaaagagtggtagtattttccaaatttacacaaaacttctctcatgatcaggcacagtggctcatgcctgtaatcccagcactttgggaggccaaggccggaggatcacttgagcccaggaattcaagaccagcctgggcaatgtggcaaaaccccatctctactaaaaatacagaaaattaggtggcggtgggggtgtgcacttgtagtcccagtgactcaggaggctcaggtgggagaatcacctgatgccaggaagtcgaggctgcagtgagcactgatggtgccactgcactctagcctgggagaaagagtgacactttatctcaaaa

SEQ ID NO: 375533 - DNA, 558 bp, Homo sapiens
gagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctg

SEQ ID NO: 375534 - DNA, 540 bp, Homo sapiens
gagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgaccaccccgcatgacccgccgcatgggggatc

SEQ ID NO: 375535 - DNA, 313 bp, Homo sapiens
caagtaaatttttttcaaaaaggatcatggttgttgtctgccctgagctttttcatgcttgagaaggtctgcctgttacatacatatatatgaacagtttagctaactgtaacattcttgttcatactttcattctgagtttgtagatttccctctctctcttctggaatggggtgtagatatggacaattctgagaacaagttcccacctagtattgtgtattagctatttattgctgcagaacagtttttcccaaaactgggcagctaaaaacaacacatacttactatcccacagtttctgtgggtcaga

SEQ ID NO: 375536 - DNA, 328 bp, Homo sapiens
ttatagacacatgcatataatttaaaagtcaaatagcccaaaaagacttataatgaaaaacatattcccccaaattccatcccactccccagaggcaagtgtcttctggcatttaccttaatttttctagacaatgtgaattatccagttaggatattccttcttgacttcttgtaaggtaactggattgagcactcctatatcaaccactcccccagcttcactttggcaccctaatcacccccatgtagttacaactgaacttttaaatagttattgtttacattatgactatggaaaaaatagttcactacagttctttcatatg

SEQ ID NO: 375537 - DNA, 1758 bp, Homo sapiens
  misc_feature (490)..(490): n is a, c, g, or t
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacntcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtgggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaagggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaagtaagttgttcgtgtctgactattcagtgatcctaagaattcagtcgtgttaatttgcaagcagaatagcaacaactgacttgaattcttgcttattgttttcttgtcaatcaaacatatggcatcatgaccagccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggtaagaatcatatgcgactgtggtatttgatttaatggggaacttttgtgaggtggagggtccagggtaaaccttagatgagttaggaacaggatattatagctaacatccagacctcagaaatacgattctctgtaaaatgggtcttaaaaagtgatttagaatttttactgaaactggctgggcatagtagctcatggctgtaatcccagaactttgcaggggccaaggtgggaggatcacttgagcccaggagttcaagaccagcctgggcaacatgacgaaacctcgtatctgcc

SEQ ID NO: 375538 - DNA, 910 bp, Homo sapiens
cgatgaggacatgagagtagtggagcaggaacgatagataaaatagcgagatgagaaggagacgtaaggagagtagcagtggatagaaatgtgttagaaaatatacgaaagatgagaaaaagagaaggaagacaagagaagagaaatacggaggatgagagatagaaaggaagaacaacgtgggaatagaatgaaagcaagagattagagaggtgcggtaggaaggtatggtcgaagaatagagtaaggtgaaggaagaaagaagagatgagtagagaaagggtaaagaaataacgtagatagatggtcatgagaatgtggaaacgggaggtcgagacgagggatatgataagacgtatatagacaaagagtaaacatcgagataatttaaaaagcattgaggtgagagctgtgaaacgaaaagtacaagtttgaatagaaaagcacgtcttcacttcaacctccacctccagtgggagaatcaaggtagaatgaataaccagacacggaacaatttgtgcttacaatgagagattttgatcacagatgctctcctcccgggtcgttttccccaaacgagtcttgtttacacacgcagatcttaaacagaggtgccatttaattttgtctttaaaccttgctccacggggggcagctggctgctacagtctcttggcaaagatgtctcttgatacttttcaggtgtagtcattagaaaaagaacagctctctcccttctcctctcactcccgcctccgcccccattatgaaggcgttcagcccactctcaaccttaaaagccaaaataaaacaaaaccctaagtgcgataacatatcagatttaaaaggggggaaaaaggtctcattaaatgaggcttcccatggctcaaagatggctctgttcttatgc

SEQ ID NO: 375539 - DNA, 534 bp, Homo sapiens
tgccttaaccgtctgggaatgcagcccaataggtctcagcctcattttacccagcccctattcaagatggagttgctctggttcacgtgcctctgacatttccaataaggatggacctatctggagggtacaggagcctggtttatgtgaaccatgaaaagcagcttcctgagaggaaaagaaccaaattcattgcctgtgattttctgactgagtggttatacaaccaaaatccaaagagggcaggggagccattcacagaatttttctccattccatttgtggaggagcggctaaagcaacagtgagtatgacacaaggctttgaataatttattcctaatttaagattgtgttaataatacttttcttccatctaagagaacaaactgatgtgatccatccaggactctgggccagtcatatttgtgactcctgtctctagttattcttagcctaggctaaccttatcctaatcaggccagtaatttcattcaagaagcactccagaaataaaatagaaaacttaaaaaaa

SEQ ID NO: 375540 - DNA, 3535 bp, Homo sapiens
  misc_feature (490)..(490): n is a, c, g, or t
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacntcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtgggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaagtaagttgttcgtgtctgactattcagtgatcctaagaattcagtcgtgttaatttgcaagcagaatagcaacaactgacttgaattcttgcttattgttttcttgtcaatcaaacatatggcatcatgaccagccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatgctttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatcaaaagtgagccttagctcttcatcagttaataaaaagcacctgctgagaactcctgtaagctggtatcatcattgcatcattggattataaaagccacaatgctccctttcaacttggggtttggcctgaggcgttcaactcagccttggccaaccgagaccaccacccgagttcacccttgttcagtgggtcctgacggcatctgggctaaaaaaaaaaaaaaaaaaaagcactgggcgcccagcttccaacaaccagatcttcaactctggaatccctggagatgcacagaacttcccagtttgtaagctgtcagagctgactcccttctcttcccaccctccacctccagtggggagaaatccaggctagaatgacaattttctattaaaaggggggacaagagtggctgttatagacccaaagcgattttaataaccagacacggaacaatttgtgcttacaatgagagattttgatcacagatgctctcctcccgggtcgttttccccaaacgagtcttgtttacacacgcagatcttaaacagaggtgccatttaattttgtctttaaaccttgctccacggggggcagctggctgctacagtctcttggcaaagatgtctcttgatacttttcaggtgtagtcattagaaaaagaacagctctctcccttctcctctcactcccgcctccgcccccattatgaaggcgttcagcccactctcaaccttaaaagccaaaataaaacaaaaccctaagtgcgataacatatcagatttaaaaggggggaaaaaggtctcattaaatgaggcttcccatggctcaaagatggctctgttcttatgc

SEQ ID NO: 375541 - DNA, 3482 bp, Homo sapiens
  misc_feature (490)..(490): n is a, c, g, or t
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacntcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtgggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagattgattgttccccctggcatctctctactccatgccaactgtcatgaatgtaaactgctcgcagagagtcttggaacacaaggaaaagaaccaaattcattgcctgtgattttctgactgagtggttatacaaccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatgctttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatcaaaagtgagccttagctcttcatcagttaataaaaagcacctgctgagaactcctgtaagctggtatcatcattgcatcattggattataaaagccacaatgctccctttcaacttggggtttggcctgaggcgttcaactcagccttggccaaccgagaccaccacccgagttcacccttgttcagtgggtcctgacggcatctgggctaaaaaaaaaaaaaaaaaaaagcactgggcgcccagcttccaacaaccagatcttcaactctggaatccctggagatgcacagaacttcccagtttgtaagctgtcagagctgactcccttctcttcccaccctccacctccagtggggagaaatccaggctagaatgacaattttctattaaaaggggggacaagagtggctgttatagacccaaagcgattttaataaccagacacggaacaatttgtgcttacaatgagagattttgatcacagatgctctcctcccgggtcgttttccccaaacgagtcttgtttacacacgcagatcttaaacagaggtgccatttaattttgtctttaaaccttgctccacggggggcagctggctgctacagtctcttggcaaagatgtctcttgatacttttcaggtgtagtcattagaaaaagaacagctctctcccttctcctctcactcccgcctccgcccccattatgaaggcgttcagcccactctcaaccttaaaagccaaaataaaacaaaaccctaagtgcgataacatatcagatttaaaaggggggaaaaaggtctcattaaatgaggcttcccatggctcaaagatggctctgttcttatgc

SEQ ID NO: 375542 - DNA, 2400 bp, Homo sapiens
tgccttaaccgtctgggaatgcagcccaataggtctcagcctcattttacccagcccctattcaagatggagttgctctggttcacgtgcctctgacatttccaataaggatggacctatctggagggtacaggagcctggtttatgtgaaccatgaaaagcagcttcctgagaggaaaagaaccaaattcattgcctgtgattttctgactgagtggttatacaaccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatgctttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatcaaaagtgagccttagctcttcatcagttaataaaaagcacctgctgagaactcctgtaagctggtatcatcattgcatcattggattataaaagccacaatgctccctttcaacttggggtttggcctgaggcgttcaactcagccttggccaaccgagaccaccacccgagttcacccttgttcagtgggtcctgacggcatctgggctaaaaaaaaaaaaaaaaaaaagcactgggcgcccagcttccaacaaccagatcttcaactctggaatccctggagatgcacagaacttcccagtttgtaagctgtcagagctgactcccttctcttcccaccctccacctccagtggggagaaatccaggctagaatgacaattttctattaaaaggggggacaagagtggctgttatagacccaaagcgattttaataaccagacacggaacaatttgtgcttacaatgagagattttgatcacagatgctctcctcccgggtcgttttccccaaacgagtcttgtttacacacgcagatcttaaacagaggtgccatttaattttgtctttaaaccttgctccacggggggcagctggctgctacagtctcttggcaaagatgtctcttgatacttttcaggtgtagtcattagaaaaagaacagctctctcccttctcctctcactcccgcctccgcccccattatgaaggcgttcagcccactctcaaccttaaaagccaaaataaaacaaaaccctaagtgcgataacatatcagatttaaaaggggggaaaaaggtctcattaaatgaggcttcccatggctcaaagatggctctgttcttatgc

SEQ ID NO: 375543 - DNA, 3185 bp, Homo sapiens
  misc_feature (490)..(490): n is a, c, g, or t
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacntcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtgggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgaggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatgctttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatcaaaagtgagccttagctcttcatcagttaataaaaagcacctgctgagaactcctgtaagctggtatcatcattgcatcattggattataaaagccacaatgctccctttcaacttggggtttggcctgaggcgttcaactcagccttggccaaccgagaccaccacccgagttcacccttgttcagtgggtcctgacggcatctgggctaaaaaaaaaaaaaaaaaaaagcactgggcgcccagcttccaacaaccagatcttcaactctggaatccctggagatgcacagaacttcccagtttgtaagctgtcagagctgactcccttctcttcccaccctccacctccagtggggagaaatccaggctagaatgacaattttctattaaaaggggggacaagagtggctgttatagacccaaagcgattttaataaccagacacggaacaatttgtgcttacaatgagagattttgatcacagatgctctcctcccgggtcgttttccccaaacgagtcttgtttacacacgcagatcttaaacagaggtgccatttaattttgtctttaaaccttgctccacggggggcagctggctgctacagtctcttggcaaagatgtctcttgatacttttcaggtgtagtcattagaaaaagaacagctctctcccttctcctctcactcccgcctccgcccccattatgaaggcgttcagcccactctcaaccttaaaagccaaaataaaacaaaaccctaagtgcgataacatatcagatttaaaaggggggaaaaaggtctcattaaatgaggcttcccatggctcaaagatggctctgttcttatgc

SEQ ID NO: 375544 - DNA, 2508 bp, Homo sapiens
  misc_feature (490)..(490): n is a, c, g, or t
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacntcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtgggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaaccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagactatgcaacagtcagccgggggaagataaaggtacattataaaacacacattaatgcatttaataaatatatattatctatcaaaagtgagccttagctcttcatcagttaataaaaagcacctgctgagaactcctgtaagctggtatcatcattgcatcattggattataaaagccacaatgctccctttcaacttggggtttggcctgaggcgttcaactcagccttggccaaccgagaccaccacccgagttcacccttgttcagtgggtcctgacggcatctgggctaaaaaaaaaaaaaaaaaaaagcactgggcgcccagcttccaacaaccagatcttcaactctggaatccctggagatgcacagaacttcccagtttgtaagctgtcagagctgactcccttctcttcccaccctccacctccagtggggagaaatccaggctagaatgacaattttctattaaaaggggggacaagagtggctgttatagacccaaagcgattttaataaccagacacggaacaatttgtgcttacaatgagagattttgatcacagatgctctcctcccgggtcgttttccccaaacgagtcttgtttacacacgcagatcttaaacagaggtgccatttaattttgtctttaaaccttgctccacggggggcagctggctgctacagtctcttggcaaagatgtctcttgatacttttcaggtgtagtcattagaaaaagaacagctctctcccttctcctctcactcccgcctccgcccccattatgaaggcgttcagcccactctcaaccttaaaagccaaaataaaacaaaaccctaagtgcgataacatatcagatttaaaaggggggaaaaaggtctcattaaatgaggcttcccatggctcaaagatggctctgttcttatgc

SEQ ID NO: 375545 - DNA, 1282 bp, Homo sapiens
  misc_feature (490)..(490): n is a, c, g, or t
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacntcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtgggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgtgagtaagagagatgccatcttttataatttggggcttttaacattgcagaaccacagggtgggtatggaggcggacagatggacctcagggagaccacatacataagaaagaatgtgttcttgttttatttttaagagacatgtcctttatttcactgatttatctttaaggttaaaaatgtaataaagataataagtaacaaa

SEQ ID NO: 375546 - DNA, 3401 bp, Homo sapiens
  misc_feature (490)..(490): n is a, c, g, or t
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacntcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtgggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaaccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatgctttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatcaaaagtgagccttagctcttcatcagttaataaaaagcacctgctgagaactcctgtaagctggtatcatcattgcatcattggattataaaagccacaatgctccctttcaacttggggtttggcctgaggcgttcaactcagccttggccaaccgagaccaccacccgagttcacccttgttcagtgggtcctgacggcatctgggctaaaaaaaaaaaaaaaaaaaagcactgggcgcccagcttccaacaaccagatcttcaactctggaatccctggagatgcacagaacttcccagtttgtaagctgtcagagctgactcccttctcttcccaccctccacctccagtggggagaaatccaggctagaatgacaattttctattaaaaggggggacaagagtggctgttatagacccaaagcgattttaataaccagacacggaacaatttgtgcttacaatgagagattttgatcacagatgctctcctcccgggtcgttttccccaaacgagtcttgtttacacacgcagatcttaaacagaggtgccatttaattttgtctttaaaccttgctccacggggggcagctggctgctacagtctcttggcaaagatgtctcttgatacttttcaggtgtagtcattagaaaaagaacagctctctcccttctcctctcactcccgcctccgcccccattatgaaggcgttcagcccactctcaaccttaaaagccaaaataaaacaaaaccctaagtgcgataacatatcagatttaaaaggggggaaaaaggtctcattaaatgaggcttcccatggctcaaagatggctctgttcttatgc

SEQ ID NO: 375547 - DNA, 3270 bp, Homo sapiens
  misc_feature (490)..(490): n is a, c, g, or t
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacntcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtgggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagcccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatgctttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatcaaaagtgagccttagctcttcatcagttaataaaaagcacctgctgagaactcctgtaagctggtatcatcattgcatcattggattataaaagccacaatgctccctttcaacttggggtttggcctgaggcgttcaactcagccttggccaaccgagaccaccacccgagttcacccttgttcagtgggtcctgacggcatctgggctaaaaaaaaaaaaaaaaaaaagcactgggcgcccagcttccaacaaccagatcttcaactctggaatccctggagatgcacagaacttcccagtttgtaagctgtcagagctgactcccttctcttcccaccctccacctccagtggggagaaatccaggctagaatgacaattttctattaaaaggggggacaagagtggctgttatagacccaaagcgattttaataaccagacacggaacaatttgtgcttacaatgagagattttgatcacagatgctctcctcccgggtcgttttccccaaacgagtcttgtttacacacgcagatcttaaacagaggtgccatttaattttgtctttaaaccttgctccacggggggcagctggctgctacagtctcttggcaaagatgtctcttgatacttttcaggtgtagtcattagaaaaagaacagctctctcccttctcctctcactcccgcctccgcccccattatgaaggcgttcagcccactctcaaccttaaaagccaaaataaaacaaaaccctaagtgcgataacatatcagatttaaaaggggggaaaaaggtctcattaaatgaggcttcccatggctcaaagatggctctgttcttatgc

SEQ ID NO: 375548 - DNA, 2699 bp, Homo sapiens
  misc_feature (14)..(14): n is a, c, g, or t
ctggcgcaacgtantcacaggctcctgtttgactttatatccttctggaaagggaggctgctcagcttcatactccttgcagatctgctcccacagattcttgcttgacggctcggtgacctgccacgacgagacaggcagctcgcgggacgcgagagacacggtgggcaccggcgtccgggtgaacgacgagtctgtagagcagctgggcttgaggcgcactatgtggctggggatttgccgcgttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaaccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatgctttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatcaaaagtgagccttagctcttcatcagttaataaaaagcacctgctgagaactcctgtaagctggtatcatcattgcatcattggattataaaagccacaatgctccctttcaacttggggtttggcctgaggcgttcaactcagccttggccaaccgagaccaccacccgagttcacccttgttcagtgggtcctgacggcatctgggctaaaaaaaaaaaaaaaaaaaagcactgggcgcccagcttccaacaaccagatcttcaactctggaatccctggagatgcacagaacttcccagtttgtaagctgtcagagctgactcccttctcttcccaccctccacctccagtggggagaaatccaggctagaatgacaattttctattaaaaggggggacaagagtggctgttatagacccaaagcgattttaataaccagacacggaacaatttgtgcttacaatgagagattttgatcacagatgctctcctcccgggtcgttttccccaaacgagtcttgtttacacacgcagatcttaaacagaggtgccatttaattttgtctttaaaccttgctccacggggggcagctggctgctacagtctcttggcaaagatgtctcttgatacttttcaggtgtagtcattagaaaaagaacagctctctcccttctcctctcactcccgcctccgcccccattatgaaggcgttcagcccactctcaaccttaaaagccaaaataaaacaaaaccctaagtgcgataacatatcagatttaaaaggggggaaaaaggtctcattaaatgaggcttcccatggctcaaagatggctctgttcttatgc

SEQ ID NO: 375549 - DNA, 3172 bp, Homo sapiens
  misc_feature (490)..(490): n is a, c, g, or t
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacntcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtgggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatcccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatgctttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatcaaaagtgagccttagctcttcatcagttaataaaaagcacctgctgagaactcctgtaagctggtatcatcattgcatcattggattataaaagccacaatgctccctttcaacttggggtttggcctgaggcgttcaactcagccttggccaaccgagaccaccacccgagttcacccttgttcagtgggtcctgacggcatctgggctaaaaaaaaaaaaaaaaaaaagcactgggcgcccagcttccaacaaccagatcttcaactctggaatccctggagatgcacagaacttcccagtttgtaagctgtcagagctgactcccttctcttcccaccctccacctccagtggggagaaatccaggctagaatgacaattttctattaaaaggggggacaagagtggctgttatagacccaaagcgattttaataaccagacacggaacaatttgtgcttacaatgagagattttgatcacagatgctctcctcccgggtcgttttccccaaacgagtcttgtttacacacgcagatcttaaacagaggtgccatttaattttgtctttaaaccttgctccacggggggcagctggctgctacagtctcttggcaaagatgtctcttgatacttttcaggtgtagtcattagaaaaagaacagctctctcccttctcctctcactcccgcctccgcccccattatgaaggcgttcagcccactctcaaccttaaaagccaaaataaaacaaaaccctaagtgcgataacatatcagatttaaaaggggggaaaaaggtctcattaaatgaggcttcccatggctcaaagatggctctgttcttatgc

SEQ ID NO: 375550 - DNA, 2685 bp, Homo sapiens
  misc_feature (490)..(490): n is a, c, g, or t
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacntcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtgggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaagtaagttgttcgtgtctgactattcagtgatcctaagaattcagtcgtgttaatttgcaagcagaatagcaacaactgacttgaattcttgcttattgttttcttgtcaatcaaacatatggcatcatgaccagccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatgctttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatc

SEQ ID NO: 375551 - DNA, 1410 bp, Homo sapiens
  misc_feature (490)..(490): n is a, c, g, or t
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacntcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtgggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgaggttgttctccagatgaccccttcgggagggaaagcctgtgtttggggtcacttacccagttccagccacaccatctagttgtgcacatacatgcgctgccatctgtctggccacttggactccggagagcttttccgccttgcttggcctcctgcctgaccttctcctgtgcagtttggcatccaccaggtttcttgggtcttcagcttctgtttattacatgcactgattaaagc

SEQ ID NO: 375552 - DNA, 770 bp, Homo sapiens
atttattaaaaaacgggcacttatttctaacagttctggaggcaggagtctaagatcaagacaccagcagattgggtgtctgatgagagcctgctgtttacctccaagatggcaccttgttgctacattctctagaggggaggaactctgtgccttcttcatctggcaaagggatagaagggcaaaaaaaaagggccaaactccctccgtgaagcccttttataatgacattaatccatttgtgagggctttgccttcacgacctgaacacctaccaaaaggccctacctcccagcagtactgcattggggattaagtttctaatacatgaattttggaggacacattcagaccccataggcagggattcagtttcgttttgtttttaaatatgggataacaaactgtcccatacgttactaaaaaaatccatacttccttcaatgattgccattcacttctgtcatgtattatattctcatttatgcatgatctatgcctgtgctctctattggtgtgtttatttatatgccaacacgttatctttataataaattttgtatgttagattaagccttttgacgttactcctctttagacatattttggcccttcatgcacttttgatcttctattgaaattttatttggggctgggcacagtggctcatgctataatcctatcattttgggaggctgaggtgggtagatcatttgaggtcagaagttcaagaccagcctggccaacatggtgagaccccgtctgtacta

SEQ ID NO: 375553 - DNA, 400 bp, Homo sapiens
gaatgagggaacatttaatgtcatttgttaggagatagaaaccaaataataaaggacaaggaccacgctcattccgtggagaagaggtgaactccctctgctgactatttggaatggactgaatgaggaggtctctccagccagaaggagtattgaggtcatcaggcctcagaaaacaatgtacacataatctcgggctgtgaacaagagaaaggagggggggaaacatgaaagtcaatcttaacaatttttgcaatacctcttatttgcagaccattggatttatgttattgcactctcggtgtgatttatcgtatgtatctgataggttttatgaattgttttgagttgtaaactcctataccctttattaaaatggacctaattaaatgaaaagaaa

SEQ ID NO: 375554 - DNA, 2118 bp, Homo sapiens
cgcaggcggaagtgagacgccggaagcggtcgttgccatggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcagatgtcagtgacagtgaggagctgagtagcctgcaggtcctagatgcagacacctttgccttctgctgtgcttcgggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctgatgtaggactcaagtgactaccagtccctgttaccagctgtgtggccttgggcaagtctgccagcgtcacttagcctcagtttccttatctgtaaaatgaggatagtaagaactacctcgtagtgatattgcgaaggttagaagaaacgcatggcataattacttggtagctattgttagatctgggagtgtgaaatggtagcgttttgtccctgtcttcacactatcatagggagaatcaaaagagctaacaaatataaacatgctttgtgaatttttttaaagaaaaaaatgtagaggggccaataaacatgaaaaaatcccagccctagtagcaattaaggaaatagcaaaacaggatttctgctcctcttgagtgggtctcatgggaacacaggtgcactttcccacacttgtccccccaggtgactaggttcaagagacatttgcttttggtggccccacaaacatttccttttgagggcccatagtgaatattaaagtgtgctggacatggtggctcatgcctgtaatcccagcactttcagaggctgaggtgggcagattgcttgagctgaggagtttgagaccagcctgggcaacatagcaagatcccttcccttaaaaaaaaaaaaaatttggctgggcatggtggctcatgcctgtaatcccagcaatgtaggcagccaaaacaggtggatcacttgagtccaggagttcgagactagcctgaggcaacacaggagaacccccatctctaaaaaaaaaaaacatgtttaggacatcacgcaagcataatgacatatgcctgtgggtcctacagaggaagcccaagcaggagcagactgaagcaggaggatctacataggagatgaaccgg

SEQ ID NO: 375555 - DNA, 2089 bp, Homo sapiens
cgcaggcggaagtgagacgccggaagcggtcgttgccatggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcagatgtcagtgacagtgaggagctgagtagcctgcaggtcctagatgcagacacctttgccttctgctgtgcttcgggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctgatgtaggactcaagtgactaccagtccctgttaccagctgtgtggccttgggcaagtctgccagcgtcacttagcctcagtttccttatctgtaaaatgaggatagtaagaactacctcgtagtgatattgcgaaggttagaagaaacgcatggcataattacttggtagctattgttagatctgggattcacactatcatagggagaatcaaaagagctaacaaatataaacatgctttgtgaatttttttaaagaaaaaaatgtagaggggccaataaacatgaaaaaatcccagccctagtagcaattaaggaaatagcaaaacaggatttctgctcctcttgagtgggtctcatgggaacacaggtgcactttcccacacttgtccccccaggtgactaggttcaagagacatttgcttttggtggccccacaaacatttccttttgagggcccatagtgaatattaaagtgtgctggacatggtggctcatgcctgtaatcccagcactttcagaggctgaggtgggcagattgcttgagctgaggagtttgagaccagcctgggcaacatagcaagatcccttcccttaaaaaaaaaaaaaatttggctgggcatggtggctcatgcctgtaatcccagcaatgtaggcagccaaaacaggtggatcacttgagtccaggagttcgagactagcctgaggcaacacaggagaacccccatctctaaaaaaaaaaaacatgtttaggacatcacgcaagcataatgacatatgcctgtgggtcctacagaggaagcccaagcaggagcagactgaagcaggaggatctacataggagatgaaccgg

SEQ ID NO: 375556 - DNA, 2465 bp, Homo sapiens
cgcaggcggaagtgagacgccggaagcggtcgttgccatggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcaggtaccgtggtactttgtcccttgcttgctgctccagccggcatcaccccccagcccaactcagccactataaaaactgagttcaactctctgtgccaggtgttggggatacacagtgaataagaggtaagccctggcctctaagggctcctatgctggggcaggattaggcagtcccagggaccagcacccaaccagctgagcagacaatggtgagatgagtgggaagggagatgtgatttattctgcctgggactggtgggaagggacctgtgaccagccagccctgccaaattgccagacccatctgcctccagccgcttgtctcctttgctgtcggtcttccagatgtcagtgacagtgaggagctgagtagcctgcaggtcctagatgcagacacctttgccttctgctgtgcttcgggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctgatgtaggactcaagtgactaccagtccctgttaccagctgtgtggccttgggcaagtctgccagcgtcacttagcctcagtttccttatctgtaaaatgaggatagtaagaactacctcgtagtgatattgcgaaggttagaagaaacgcatggcataattacttggtagctattgttagatctgggagtgtgaaatggtagcgttttgtccctgtcttcacactatcatagggagaatcaaaagagctaacaaatataaacatgctttgtgaatttttttaaagaaaaaaatgtagaggggccaataaacatgaaaaaatcccagccctagtagcaattaaggaaatagcaaaacaggatttctgctcctcttgagtgggtctcatgggaacacaggtgcactttcccacacttgtccccccaggtgactaggttcaagagacatttgcttttggtggccccacaaacatttccttttgagggcccatagtgaatattaaagtgtgctggacatggtggctcatgcctgtaatcccagcactttcagaggctgaggtgggcagattgcttgagctgaggagtttgagaccagcctgggcaacatagcaagatcccttcccttaaaaaaaaaaaaaatttggctgggcatggtggctcatgcctgtaatcccagcaatgtaggcagccaaaacaggtggatcacttgagtccaggagttcgagactagcctgaggcaacacaggagaacccccatctctaaaaaaaaaaaacatgtttaggacatcacgcaagcataatgacatatgcctgtgggtcctacagaggaagcccaagcaggagcagactgaagcaggaggatctacataggagatgaaccgg

SEQ ID NO: 375557 - DNA, 2231 bp, Homo sapiens
cgcaggcggaagtgagacgccggaagcggtcgttgccatggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcaggtgttggggatacacagtgaataagaggtaagccctggcctctaagggctcctatgctggggcaggattaggcagtcccagggaccagcacccaaccagctgagcagacaatgatgtcagtgacagtgaggagctgagtagcctgcaggtcctagatgcagacacctttgccttctgctgtgcttcgggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctgatgtaggactcaagtgactaccagtccctgttaccagctgtgtggccttgggcaagtctgccagcgtcacttagcctcagtttccttatctgtaaaatgaggatagtaagaactacctcgtagtgatattgcgaaggttagaagaaacgcatggcataattacttggtagctattgttagatctgggagtgtgaaatggtagcgttttgtccctgtcttcacactatcatagggagaatcaaaagagctaacaaatataaacatgctttgtgaatttttttaaagaaaaaaatgtagaggggccaataaacatgaaaaaatcccagccctagtagcaattaaggaaatagcaaaacaggatttctgctcctcttgagtgggtctcatgggaacacaggtgcactttcccacacttgtccccccaggtgactaggttcaagagacatttgcttttggtggccccacaaacatttccttttgagggcccatagtgaatattaaagtgtgctggacatggtggctcatgcctgtaatcccagcactttcagaggctgaggtgggcagattgcttgagctgaggagtttgagaccagcctgggcaacatagcaagatcccttcccttaaaaaaaaaaaaaatttggctgggcatggtggctcatgcctgtaatcccagcaatgtaggcagccaaaacaggtggatcacttgagtccaggagttcgagactagcctgaggcaacacaggagaacccccatctctaaaaaaaaaaaacatgtttaggacatcacgcaagcataatgacatatgcctgtgggtcctacagaggaagcccaagcaggagcagactgaagcaggaggatctacataggagatgaaccgg

SEQ ID NO: 375558 - DNA, 3165 bp, Homo sapiens
cgcaggcggaagtgagacgccggaagcggtcgttgccatggatcctggggacgactggctggtggaatccttgcgcttaaatcgtacggggctgggacatgggagctgggcctggagcttgcctggcgggcggatgggtgtgggtggaggcacgttggggatcctggtgcagagtgggccagctgtggcctcggggctcgccaccgtggaggactccgcctgggcctaggcccccatctctaggaaatggctccttcctgcgtgcgcgcgttgtgagattactagtaggagccgcgcttgtgaagacgcagtgcccagttagtttgcgccagcctctgagttcagctcagaacacagatgatctcattgattcctcacgtcaaccttgggaaatctgggtaccctgggacgtccacacatgaggaccgaggctcagggacatcaagggactggcctggtcccagaaacagggagtaaaatgggaagtaaactcagtcccacgtctgcctgactccagagtttgggccactgaaccatgcggctgccatctttggagttctttgagctgtgaagtgctgtgcatcgtgtgattctgtgtcccttttgtgcaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccaggtatggtcaattttgtgatccagccatccacacaggatgggatgggatggctgcaaatgcctgggggtattctgcctcctcatctccattcccaccccctcagcacacaggcacatgtgagtgcacaagtgtgtgcacacagatacacacagatttagaatacaaagaaaccactgctgtggcttcatagccccccagagcccttggactaatgtaagtaacagttctaccggagttgctccagggaatagatacgggacagaaagatgctcttctattgctcttgggtgataattgctcagttgggagaggccaagagtctctgggtcaggttgtgtttggccccatacttgtgtcctctgtaggtgaccatcatgacacatggaagcttgggctcagtctccctaaagttgattgagcctgctccttatctgtgaaatgagggtggttggccttgatgatcttgcagtaagatgtcctgatatgggaagtgcagtcccaagctaagtgtgctggaaaggggaagggacctgtgtggataagctccccatggtctggactgattttgtcttttctgaatagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcagatgtcagtgacagtgaggagctgagtagcctgcaggtcctagatgcagacacctttgccttctgctgtgcttcgggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctgatgtaggactcaagtgactaccagtccctgttaccagctgtgtggccttgggcaagtctgccagcgtcacttagcctcagtttccttatctgtaaaatgaggatagtaagaactacctcgtagtgatattgcgaaggttagaagaaacgcatggcataattacttggtagctattgttagatctgggagtgtgaaatggtagcgttttgtccctgtcttcacactatcatagggagaatcaaaagagctaacaaatataaacatgctttgtgaatttttttaaagaaaaaaatgtagaggggccaataaacatgaaaaaatcccagccctagtagcaattaaggaaatagcaaaacaggatttctgctcctcttgagtgggtctcatgggaacacaggtgcactttcccacacttgtccccccaggtgactaggttcaagagacatttgcttttggtggccccacaaacatttccttttgagggcccatagtgaatattaaagtgtgctggacatggtggctcatgcctgtaatcccagcactttcagaggctgaggtgggcagattgcttgagctgaggagtttgagaccagcctgggcaacatagcaagatcccttcccttaaaaaaaaaaaaaatttggctgggcatggtggctcatgcctgtaatcccagcaatgtaggcagccaaaacaggtggatcacttgagtccaggagttcgagactagcctgaggcaacacaggagaacccccatctctaaaaaaaaaaaacatgtttaggacatcacgcaagcataatgacatatgcctgtgggtcctacagaggaagcccaagcaggagcagactgaagcaggaggatctacataggagatgaaccgg

SEQ ID NO: 375559 - DNA, 2651 bp, Homo sapiens
cgcaggcggaagtgagacgccggaagcggtcgttgccatggatcctggggacgactggctggtggaatccttgcgcttaaatcgtacggggctgggacatgggagctgggcctggagcttgcctggcgggcggatgggtgtgggtggaggcacgttggggatcctggtgcagagtgggccagctgtggcctcggggctcgccaccgtggaggactccgcctgggcctaggcccccatctctaggaaatggctccttcctgcgtgcgcgcgttgtgagattactagtaggagccgcgcttgtgaagacgcagtgcccagttagtttgcgccagcctctgagttcagctcagaacacagatgatctcattgattcctcacgtcaaccttgggaaatctgggtaccctgggacgtccacacatgaggaccgaggctcagggacatcaagggactggcctggtcccagaaacagggagtaaaatgggaagtaaactcagtcccacgtctgcctgactccagagtttgggccactgaaccatgcggctgccatctttggagttctttgagctgtgaagtgctgtgcatcgtgtgattctgtgtcccttttgtgcaggtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcagatgtcagtgacagtgaggagctgagtagcctgcaggtcctagatgcagacacctttgccttctgctgtgcttcgggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctgatgtaggactcaagtgactaccagtccctgttaccagctgtgtggccttgggcaagtctgccagcgtcacttagcctcagtttccttatctgtaaaatgaggatagtaagaactacctcgtagtgatattgcgaaggttagaagaaacgcatggcataattacttggtagctattgttagatctgggagtgtgaaatggtagcgttttgtccctgtcttcacactatcatagggagaatcaaaagagctaacaaatataaacatgctttgtgaatttttttaaagaaaaaaatgtagaggggccaataaacatgaaaaaatcccagccctagtagcaattaaggaaatagcaaaacaggatttctgctcctcttgagtgggtctcatgggaacacaggtgcactttcccacacttgtccccccaggtgactaggttcaagagacatttgcttttggtggccccacaaacatttccttttgagggcccatagtgaatattaaagtgtgctggacatggtggctcatgcctgtaatcccagcactttcagaggctgaggtgggcagattgcttgagctgaggagtttgagaccagcctgggcaacatagcaagatcccttcccttaaaaaaaaaaaaaatttggctgggcatggtggctcatgcctgtaatcccagcaatgtaggcagccaaaacaggtggatcacttgagtccaggagttcgagactagcctgaggcaacacaggagaacccccatctctaaaaaaaaaaaacatgtttaggacatcacgcaagcataatgacatatgcctgtgggtcctacagaggaagcccaagcaggagcagactgaagcaggaggatctacataggagatgaaccgg

SEQ ID NO: 375560 - DNA, 2281 bp, Homo sapiens
cgcaggcggaagtgagacgccggaagcggtcgttgccatggatcctggggacgactggctggtggaatccttgcgcttaaatcgtacggggctgggacatgggagctgggcctggagcttgcctggcgggcggatgggtgtgggtggaggcacgttggggatcctggtgcagagtgggccagctgtggcctcggggctcgccaccgtggaggactccgcctgggcctaggcccccatctctaggaaatggctccttcctgcgtgcgcgcgttgtgagattactagtaggagccgcgcttgtgaagacgcagtgcccagttagtttgcgccagcctctgagttcagctcagaacacagatgatctcattgattcctcacgtcaaccttgggaaatctgggtaccctgggacgtccacacatgaggaccgaggctcagggacatcaagggactggcctggtcccagaaacagggagtaaaatgggaagtaaactcagtcccacgtctgcctgactccagagtttgggccactgaaccatgcggctgccatctttggagttctttgagctgtgaagtgctgtgcatcgtgtgattctgtgtcccttttgtgcaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccaggtatggtcaattttgtgatccagccatccacacaggatgggatgggatggctgcaaatgcctgggggtattctgcctcctcatctccattcccaccccctcagcacacaggcacatgtgagtgcacaagtgtgtgcacacagatacacacagatttagaatacaaagaaaccactgctgtggcttcatagccccccagagcccttggactaatgtaagtaacagttctaccggagttgctccagggaatagatacgggacagaaagatgctcttctattgctcttgggtgataattgctcagttgggagaggccaagagtctctgggtcaggttgtgtttggccccatacttgtgtcctctgtaggtgaccatcatgacacatggaagcttgggctcagtctccctaaagttgattgagcctgctccttatctgtgaaatgagggtggttggccttgatgatcttgcagtaagatgtcctgatatgggaagtgcagtcccaagctaagtgtgctggaaaggggaagggacctgtgtggataagctccccatggtctggactgattttgtcttttctgaatagattgctggttaccagtggccttccaggttgttatctgcaggtgtggcaggttgcagaggacagtggtgagtgaatttgacttgatggggtttggggttctaggaaagtgtgactcatacacccctgtcccctaatctgagccagttaagaaggagactcaggctggggacagtctcatgcctgtaattgtagcactttgggaggctgagctgggtggatcacttgaattcaggagttgaagaccaccttgtacaacatggtgaaacctgtctctattaaaaatacaaaaaattagccgggcatggtggtaggcacctgtaatccctgctactggggagactgaggcaggagaattgcttgaacctgggaggcggaggttacagtgagccgagatcatgccactgcactccagcctgggcaacaagagcaaaactccgtctccaaaaaaaaagtagtagtagactcagagccaggtgggaattaatctactttaatgcagacaaggtgaattagcaaccatagcatggcatccaagccccaaatggagcttcctgtaacctgctcctggaattgagttcatccagagaactactctccctaggcaggggcagtggcaacagcagagcttaggctgctcaggtgagctcacctctttggcagcattaagcatatattaagagaagcctcagatgtagaatacagagaggagaacctacctgctaaccaagcaggtggagacaaccaaataaaaactaaaacttggctgggcgcagtggctcatgcctgtaatcccagcactttgggaggccaaggtaggtgggtcacctgaccaggagtttgagcccagcccgagcaacatggcgaaaccccgtctctactaaaaatacaaaaaaattagctgggcatgagg

SEQ ID NO: 375561 - DNA, 1234 bp, Homo sapiens
cgcaggcggaagtgagacgccggaagcggtcgttgccatggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtggtgagtgaatttgacttgatggggtttggggttctaggaaagtgtgactcatacacccctgtcccctaatctgagccagttaagaaggagactcaggctggggacagtctcatgcctgtaattgtagcactttgggaggctgagctgggtggatcacttgaattcaggagttgaagaccaccttgtacaacatggtgaaacctgtctctattaaaaatacaaaaaattagccgggcatggtggtaggcacctgtaatccctgctactggggagactgaggcaggagaattgcttgaacctgggaggcggaggttacagtgagccgagatcatgccactgcactccagcctgggcaacaagagcaaaactccgtctccaaaaaaaaagtagtagtagactcagagccaggtgggaattaatctactttaatgcagacaaggtgaattagcaaccatagcatggcatccaagccccaaatggagcttcctgtaacctgctcctggaattgagttcatccagagaactactctccctaggcaggggcagtggcaacagcagagcttaggctgctcaggtgagctcacctctttggcagcattaagcatatattaagagaagcctcagatgtagaatacagagaggagaacctacctgctaaccaagcaggtggagacaaccaaataaaaactaaaacttggctgggcgcagtggctcatgcctgtaatcccagcactttgggaggccaaggtaggtgggtcacctgaccaggagtttgagcccagcccgagcaacatggcgaaaccccgtctctactaaaaatacaaaaaaattagctgggcatgagg

SEQ ID NO: 375562 - DNA, 1255 bp, Homo sapiens
taaatgctgagtatgtcaacttttatttatttattaaacatttgtggagctcctgttatctaccaggtattgtcctggatactagaaagagagaaagcgctaggcctgcccttctagtctaacagagggaggcacatatgcacagagataaatgctgtagaatgtctcgtggtttacagagggctatcagaggaggaggtcagttatactttatcagaaatagatttagggagcgattaaggatatagagggcggtcgaaatgcgtagagtggttaaagtcacctagtgaatgtgtggtatataaggagtgaggagaatatagtgaggacggaacctcagggaacacatttaagggatgagtacaggaagatgcaccccccctccccaaagaatactaagaaagaacagcctctgaggtaagaggaatctcagaaaaggtcaatgtttctgaagccaagagaagagaacttctcaagaaaaaaagagttagtagctgtctagagttccaataaaatcattgagagaagaattgaaggccaggtgcagtggcttacgcctgtaatcccagcactttgggaggccgagttgggcggatcatgaggtcaggagttcgggaccatcctgaccaacatggtgaaaccccgtctctactaaaaatacaaaaattagccaggcatggtggcgcacacctgtaatcccaccctagtagcaattaaggaaatagcaaaacaggatttctgctcctcttgagtgggtctcatgggaacacaggtgcactttcccacacttgtccccccaggtgactaggttcaagagacatttgcttttggtggccccacaaacatttccttttgagggcccatagtgaatattaaagtgtgctggacatggtggctcatgcctgtaatcccagcactttcagaggctgaggtgggcagattgcttgagctgaggagtttgagaccagcctgggcaacatagcaagatcccttcccttaaaaaaaaaaaaaatttggctgggcatggtggctcatgcctgtaatcccagcaatgtaggcagccaaaacaggtggatcacttgagtccaggagttcgagactagcctgaggcaacacaggagaacccccatctctaaaaaaaaaaaacatgtttaggacatcacgcaagcataatgacatatgcctgtgggtcctacagaggaagcccaagcaggagcagactgaagcaggaggatctacataggagatgaaccgg

SEQ ID NO: 375563 - DNA, 374 bp, Homo sapiens
tttcccacacttgtccccccaggtgactaggttcaagagacatttgcttttggtggccccacaaacatttccttttgagggcccatagtgaatattaaagtgtgctggacatggtggctcatgcctgtaatcccagcactttcagaggctgaggtgggcagattgcttgagctgaggagtttgagaccagcctgggcaacatagcaagatcccttcccttaaaaaaaaaaaaaatttggctgggcatggtggctcatgcctgtaatcccagcaatgtaggcagccaaaacaggtggatcacttgagtccaggagttcgagactagcctgaggcaacatggcgaaaccttgtctctactaaaaatacaagttagc

SEQ ID NO: 375564 - DNA, 1496 bp, Homo sapiens
cgcaggcggaagtgagacgccggaagcggtcgttgccatggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcagatgtcagtgacagtgaggagctgagtagcctgcaggtcctagatgcagacacctttgccttctgctgtgcttcgggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctgatgtaggactcaagtgactaccagtccctgttaccagctgtgtggccttgggcaagtctgccagcgtcacttagcctcagtttccttatctgtaaaatgaggatagtaagaactacctcgtagtgatattgcgaaggttagaagaaacgcatggcataattacttggtagctattgttagatctgggagtgtgaaatggtagcgttttgtccctgtcttcacactatcatagggagaatcaaaagagctaacaaatat

SEQ ID NO: 375565 - DNA, 2583 bp, Homo sapiens
cgcaggcggaagtgagacgccggaagcggtcgttgccatggatcctggggacgactggctggtggaatccttgcgcttaaatcgtacggggctgggacatgggagctgggcctggagcttgcctggcgggcggatgggtgtgggtggaggcacgttggggatcctggtgcagagtgggccagctgtggcctcggggctcgccaccgtggaggactccgcctgggcctaggcccccatctctaggaaatggctccttcctgcgtgcgcgcgttgtgagattactagtaggagccgcgcttgtgaagacgcagtgcccagttagtttgcgccagcctctgagttcagctcagaacacagatgatctcattgattcctcacgtcaaccttgggaaatctgggtaccctgggacgtccacacatgaggaccgaggctcagggacatcaagggactggcctggtcccagaaacagggagtaaaatgggaagtaaactcagtcccacgtctgcctgactccagagtttgggccactgaaccatgcggctgccatctttggagttctttgagctgtgaagtgctgtgcatcgtgtgattctgtgtcccttttgtgcaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcagatgtcagtgacagtgaggagctgagtagcctgcaggtcctagatgcagacacctttgccttctgctgtgcttcgggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctgatgtaggactcaagtgactaccagtccctgttaccagctgtgtggccttgggcaagtctgccagcgtcacttagcctcagtttccttatctgtaaaatgaggatagtaagaactacctcgtagtgatattgcgaaggttagaagaaacgcatggcataattacttggtagctattgttagatctgggagtgtgaaatggtagcgttttgtccctgtcttcacactatcatagggagaatcaaaagagctaacaaatataaacatgctttgtgaatttttttaaagaaaaaaatgtagaggggccaataaacatgaaaaaatcccagccctagtagcaattaaggaaatagcaaaacaggatttctgctcctcttgagtgggtctcatgggaacacaggtgcactttcccacacttgtccccccaggtgactaggttcaagagacatttgcttttggtggccccacaaacatttccttttgagggcccatagtgaatattaaagtgtgctggacatggtggctcatgcctgtaatcccagcactttcagaggctgaggtgggcagattgcttgagctgaggagtttgagaccagcctgggcaacatagcaagatcccttcccttaaaaaaaaaaaaaatttggctgggcatggtggctcatgcctgtaatcccagcaatgtaggcagccaaaacaggtggatcacttgagtccaggagttcgagactagcctgaggcaacacaggagaacccccatctctaaaaaaaaaaaacatgtttaggacatcacgcaagcataatgacatatgcctgtgggtcctacagaggaagcccaagcaggagcagactgaagcaggaggatctacataggagatgaaccgg

SEQ ID NO: 375566 - DNA, 2890 bp, Homo sapiens
cgcaggcggaagtgagacgccggaagcggtcgttgccatggatcctggggacgactggctggtggaatccttgcgcttaaatcgtacggggctgggacatgggagctgggcctggagcttgcctggcgggcggatgggtgtgggtggaggcacgttggggatcctggtgcagagtgggccagctgtggcctcggggctcgccaccgtggaggactccgcctgggcctaggcccccatctctaggaaatggctccttcctgcgtgcgcgcgttgtgagattactagtaggagccgcgcttgtgaagacgcagtgcccagttagtttgcgccagcctctgagttcagctcagaacacagatgatctcattgattcctcacgtcaaccttgggaaatctgggtaccctgggacgtccacacatgaggaccgaggctcagggacatcaagggactggcctggtcccagaaacagggagtaaaatgggaagtaaactcagtcccacgtctgcctgactccagagtttgggccactgaaccatgcggctgccatctttggagttctttgagctgtgaagtgctgtgcatcgtgtgattctgtgtcccttttgtgcaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccaggtatggtcaattttgtgatccagccatccacacaggatgggatgggatggctgcaaatgcctgggggtattctgcctcctcatctccattcccaccccctcagcacacaggcacatgtgagtgcacaagtgtgtgcacacagatacacacagatttagaatacaaagaaaccactgctgtggcttcatagccccccagagcccttggactaatgtaagtaacagttctaccggagttgctccagggaatagatacgggacagaaagatgctcttctattgctcttgggtgataattgctcagttgggagaggccaagagtctctgggtcaggttgtgtttggccccatacttgtgtcctctgtaggtgaccatcatgacacatggaagcttgggctcagtctccctaaagttgattgagcctgctccttatctgtgaaatgagggtggttggccttgatgatcttgcagtaagatgtcctgatatgggaagtgcagtcccaagctaagtgtgctggaaaggggaagggacctgtgtggataagctccccatggtctggactgattttgtcttttctgaatagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcaggtaccgtggtactttgtcccttgcttgctgctccagccggcatcaccccccagcccaactcagccactataaaaactgagttcaactctctgtgccaggtgttggggatacacagtgaataagaggtaagccctggcctctaagggctcctatgctggggcaggattaggcagtcccagggaccagcacccaaccagctgagcagacaatggtgagatgagtgggaagggagatgtgatttattctgcctgggactggtgggaagggacctgtgaccagccagccctgccaaattgccagacccatctgcctccagccgcttgtctcctttgctgtcggtcttccagatgtcagtgacagtgaggagctgagtagcctgcaggtcctagatgcagacacctttgccttctgctgtgcttcgggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctgatgtaggactcaagtgactaccagtccctgttaccagctgtgtggccttgggcaagtctgccagcgtcacttagcctcagtttccttatctgtaaaatgaggatagtaagaactacctcgtagtgatattgcgaaggttagaagaaacgcatggcataattacttggtagctattgttagatctgggagtgtgaaatggtagcgttttgtccctgtcttcacactatcatagggagaatcaaaagagctaacaaatat

SEQ ID NO: 375567 - DNA, 2144 bp, Homo sapiens
  misc_feature (275)..(275): n is a, c, g, or t
gatatccttgagaccattgactagatagtaccttgtccgtgttcgtaccacgatacttgcttacgagctgatcagatcactcattcgctgcactggattgttgattgaggagtctatcgctgctgctataaaaccctgaaaacgaatgataatcattacactcatgacatttagcctcatctatgactcacttgtcagatggagagatagcaaatgggcttgagttcaccaagaggacgaggagtttcgcaatgtgcggccgagttggccgtgantatccttcagactagtgatctatcctatccgatcataatcgcactgtagcctccataccaatatggcctcgagttcacctagatgagtctatccaaggtttgttatcctagcaaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcagatgtcagtgacagtgaggagctgagtagcctgcaggtcctagatgcagacacctttgccttctgctgtgcttcgggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctgatgtaggactcaagtgactaccagtccctgttaccagctgtgtggccttgggcaagtctgccagcgtcacttagcctcagtttccttatctgtaaaatgaggatagtaagaactacctcgtagtgatattgcgaaggttagaagaaacgcatggcataattacttggtagctattgttagatctgggagtgtgaaatggtagcgttttgtccctgtcttcacactatcatagggagaatcaaaagagctaacaaatataaacatgctttgtgaatttttttaaagaaaaaaatgtagaggggccaataaacatgaaaaaatcccagccctagtagcaattaaggaaatagcaaaacaggatttctgctcctcttgagtgggtctcatgggaacacaggtgcactttcccacacttgtccccccaggtgactaggttcaagagacatttgcttttggtggccccacaaacatttccttttgagggcccatagtgaatattaaagtgtgctggacatggtggctcatgcctgtaatcccagcactttcagaggctgaggtgggcagattgcttgagctgaggagtttgagaccagcctgggcaacatagcaagatcccttcccttaaaaaaaaaaaaaatttggctgggcatggtggctcatgcctgtaatcccagcaatgtaggcagccaaaacaggtggatcacttgagtccaggagttcgagactagcctgaggcaacacaggagaacccccatctctaaaaaaaaaaaacatgtttaggacatcacgcaagcataatgacatatgcctgtgggtcctacagaggaagcccaagcaggagcagactgaagcaggaggatctacataggagatgaaccgg

SEQ ID NO: 375568 - DNA, 1950 bp, Homo sapiens
cgcaggcggaagtgagacgccggaagcggtcgttgccatggatcctggggacgactggctggtggaatccttgcgcttaaatcgtacggggctgggacatgggagctgggcctggagcttgcctggcgggcggatgggtgtgggtggaggcacgttggggatcctggtgcagagtgggccagctgtggcctcggggctcgccaccgtggaggactccgcctgggcctaggcccccatctctaggaaatggctccttcctgcgtgcgcgcgttgtgagattactagtaggagccgcgcttgtgaagacgcagtgcccagttagtttgcgccagcctctgagttcagctcagaacacagatgatctcattgattcctcacgtcaaccttgggaaatctgggtaccctgggacgtccacacatgaggaccgaggctcagggacatcaagggactggcctggtcccagaaacagggagtaaaatgggaagtaaactcagtcccacgtctgcctgactccagagtttgggccactgaaccatgcggctgccatctttggagttctttgagctgtgaagtgctgtgcatcgtgtgattctgtgtcccttttgtgcaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccaggtatggtcaattttgtgatccagccatccacacaggatgggatgggatggctgcaaatgcctgggggtattctgcctcctcatctccattcccaccccctcagcacacaggcacatgtgagtgcacaagtgtgtgcacacagatacacacagatttagaatacaaagaaaccactgctgtggcttcatagccccccagagcccttggactaatgtaagtaacagttctaccggagttgctccagggaatagattgctggttaccagtggccttccaggttgttatctgcaggtgtggcaggttgcagaggacagtggtgagtgaatttgacttgatggggtttggggttctaggaaagtgtgactcatacacccctgtcccctaatctgagccagttaagaaggagactcaggctggggacagtctcatgcctgtaattgtagcactttgggaggctgagctgggtggatcacttgaattcaggagttgaagaccaccttgtacaacatggtgaaacctgtctctattaaaaatacaaaaaattagccgggcatggtggtaggcacctgtaatccctgctactggggagactgaggcaggagaattgcttgaacctgggaggcggaggttacagtgagccgagatcatgccactgcactccagcctgggcaacaagagcaaaactccgtctccaaaaaaaaagtagtagtagactcagagccaggtgggaattaatctactttaatgcagacaaggtgaattagcaaccatagcatggcatccaagccccaaatggagcttcctgtaacctgctcctggaattgagttcatccagagaactactctccctaggcaggggcagtggcaacagcagagcttaggctgctcaggtgagctcacctctttggcagcattaagcatatattaagagaagcctcagatgtagaatacagagaggagaacctacctgctaaccaagcaggtggagacaaccaaataaaaactaaaacttggctgggcgcagtggctcatgcctgtaatcccagcactttgggaggccaaggtaggtgggtcacctgaccaggagtttgagcccagcccgagcaacatggcgaaaccccgtctctactaaaaatacaaaaaaattagctgggcatgagg

SEQ ID NO: 375569 - DNA, 318 bp, Homo sapiens
tccagtaatttgagaaacctattaatctacatgacaactcaaagaatgacttcaggagattaggaaaaaagcaaaaaagaaggcagtggggaatatttggctgggttctggtggctcattcctgtaatcacagccctaggggaggccaaggcaggcgcatcacttgaagtcaggagttcgagaacagactggccaatttggtgaaacccagtcacgactaaaaatacaaaaaatttagttgggcgtcgtgacccacgcctctaatcccaggtactcgggaggctgaagcaggaggaccacatgaactcaggaagcaag

SEQ ID NO: 375570 - DNA, 174 bp, Homo sapiens
tagctgaaaattctactttgggaaataggacaatcaaaatgtagcctagacactgaaatgcttttaaaaatttggacaagtaaaaccacttaacaaaaaatagtgactgtggtccatgcaaaaacatgtatacaaatatttatagctgtatcattcataatagcaaaaaaaaga

SEQ ID NO: 375571 - DNA, 533 bp, Homo sapiens
agttttagtagagatggagtttcaccatattggtcaggctggtttcgaactctcagcctcccaaagtgctgggatcacaggtgtgagccatcacgcccagcctttaatggagctgatatttaataggattgaatgattacagtatgggcatctgctggtacaaaatctgaattataggaagataatggggctcatcttttcaccattgggtccccaacccctgctttgcacgcagtaggaggttagtattgtggaacgagaggcattacattgttttattgtaaggcattgttctcagcagtcctggttgaatcagtaaatccaggcatctacctaatcatctaatcacgaggttgtcatctcgcgattacgcgtgcccagtaggctttcttaggggtgtgccgacttgcctatcaataactacctgttattgataggcaaggctaggttggccctgcctagctttcttaactctggcaggccagacctgcccatggctgttgtctcttcccctgacccacccccagcctaca

SEQ ID NO: 375572 - DNA, 1300 bp, Homo sapiens
  misc_feature (1044)..(1045): n is a, c, g, or t
  misc_feature (1122)..(1122): n is a, c, g, or t
  misc_feature (1219)..(1219): n is a, c, g, or t
  misc_feature (1299)..(1299): n is a, c, g, or t
acttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggtgagcactgcccttggtgtagcgctgtgcagggtgagcactgttcctgggtcagggtggtgcagggtgagcccacccctgggtcagggtgcagggtgagcgccgttcctgggtcagggtggtacagggtgagcaccattcctgggtgagggtgcagggtgagcccacccctgggtcagggtgcaggatgaacactgttcctggatcaggatggtgcagggtgaacccacccctcagtccatgtgcaggatgagcgtcgtccctgggtcagggtgcatgatgagcaccgcccctgggtcagggtgcagggtgagcgccacctctggtgcagggggcagggtgagcgccacctctggtgcagggtgcagggtgagcgccacctctggtgcagggtgcagggtgagcgccacctctggtgcagggctgtgcggggtgcagggtgagcgccaccccggggtcaggatggtgcagggtgagcactgcccctggtgcagggctgtgtaccgtgcaagatgcagggtgagtgcccgttcctgggtggcctcaatggtaccggcaacgatggcagacagcacttggtctgtgtgtgtgttcagctctgattctcctgactccccccagcagctcctgtgattcaccccactgtgcagatgagtaaatggaggcctatggagaaagctgggcctagaaccctccctcttccccactctgtcccctgcagccatgaggtgggagagtcctgacatgtgcattcctgtggataaaaagggagggactgggccaggcgcggtggctcacacctgtnntcccagcactttgggaggctgaggcaggtggatcacaaggtcaggagatcaagaccaccctggctaacacggtgaanccccgtctctactaaaaatacaaaaaattagctgggtgtggtggcgggcacctgtaatcccagctactcggggggctgaggcaggagagtggcgtgnacccgggaggtggagcttgcagtgagccgagatatcgtgccactgcattccagcctgggcgtcagagtgagactctgtcnc

SEQ ID NO: 375573 - DNA, 1609 bp, Homo sapiens
acttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacactgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaa

SEQ ID NO: 375574 - DNA, 1372 bp, Homo sapiens
cttagctgtgtgtcctgcagccgtctcatcctctctggatagaaattatcaagagtttcttaacgtttaagtgatagctttttaaagacaaggttttttgtcccagagtaactcagacttaccaagttgtacttaccaatgttgaaagtgcagcttctgctggagtcgccttttcaactcctaacttcaccttttcaaatgtcagccatgtatctgagcattgcggagccgagtgtggtgagatcttgacaccagccaccacgcctcccaggccggccccgtcctgcggcggttggaactcagcctgtggctccccagtggggtcagtcaaagccaagtgcagtggctgaccttttatacccataaacaaagatgagcaagagtgagactgacccgcagatgagggcacgtggctgtgggggcatgggagtgggggctgcagagccacagcgctgtctgtgcccgcaggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaa

SEQ ID NO: 375575 - DNA, 1340 bp, Homo sapiens
acttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacactgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacaggtagggctccccgggacacggggacacggagggacac

SEQ ID NO: 375576 - DNA, 337 bp, Homo sapiens
ccaggctcaggcaatccttctgcttcttcctgagtagctgagaccacaggtgcacactgccacacccagctaatttttaaacattatttgtagaaatggggcctccctatgttgctcaggcggtcttgaactcctaggctcaagcagtcctcctgcctgggcctcccaaactgctgggataacaggtttgaaccactgcacctgccctaaacctgacctttgaaacaccatttactctacaaagactgtcttgaaagaagtaaactttgcctcttagatcgaaatataaagtaagcttaaagaaatattgaaaatgcaataaatctctttgttccta

SEQ ID NO: 375577 - DNA, 527 bp, Homo sapiens
tggacttaacagatatgtacagaacatttcatccaacaatcacggaatacacattctattcaacagcacatggaagtttctccaagatagaccatatgataggccacaaaacgagcctcagtaaatctaagaaaattaaaatatatcaagtactctctcagaccacagtggaatcaaactggaaatcaattccaaaagcaaccttcaaaaccatgcaaatacgtggaaattaaataacctgttcctgaatgatcattgggtcaaaaatgtaatcacgatggaaatttaaaaattattcaaactcaacgacaataatgacacaacctgtcaaacctctgggatacagcaaaggggatactagtaggaaagttcatagccctaaacacctatcaaaaagactgaaagggcagaaactgacattctaaagtcacacctcaaggagctatagaaacaagaacaaaccaaacccaaacccagcagtagaaaggaaataaccaagatcagagcagaactagatgaaattgaaa

SEQ ID NO: 375578 - DNA, 3126 bp, Homo sapiens
ccttgtgcatttggtctgaagacaaagatgactgcaggagtgggcaggccggagtgggggtgacctggcctgtgccaggaaggaggaggagtctgcagccctgtgcggttcaacatccatcaaggagtccagagcaggagccaggccaggcgggagggaaaggccctgggaggggctctctaatctcccagccccgactctgccccgtcactgccgctgctcctcattactcgctggggctgctgtcgcctccccgaagggtggccttgtccagatagtggcaaacctccctgccgtggatgagtcaggagcattttcttaagaggaacatcactggaaaacaaaatgagcggggacacagaaaccaacagcagtggctgcatttgtggtacaggctcctcttccagagctcgctgatgcccacctcagacaggcctgaccacggcacggctggtgggatttgccagtcacctcaaccagccagttccaccctcagcttctctcagaagggagcaccacactcctcaagctcagtgaatgtatcccggcatgggtggggccagagcctgtgatatctcgaggtgggctcggcaggacaccggggtgtggaagggggaagcgagcacctgactcagacagcgcgggagctcgcaggagtcacgaggccacagcgacttcattgtctgactgggcctggacctataaacttcccacctcagccttgggccaagcctggaagataaaaatggagcaccccatggcgcccctcactcagattctcccctgggcttctcccacgcagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgga

SEQ ID NO: 375579 - DNA, 2823 bp, Homo sapiens
  misc_feature (713)..(713): n is a, c, g, or t
ggtcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtgagcaggtgatcacagaagagggtggagaggtggggtggggtgggcattgctagtccataaaggtccttggtatgaattagaagaaggcactccttcctcaccntgaggggtgtggatgcagcccagaacacaacttggagagcagagctgggctacatgtcaaccaaagcatatgcgagggccctgagaggctgcatacattacacatactagcaactgggagcagacatggccttatgagatgaggctagcctggctaggggcctgacataggagcactacataggctcagcctctctcccaggagagagactgagacttgcctctcccctcctactccaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaaggtgagcaggcagccttccccagtgtactctgg

SEQ ID NO: 375580 - DNA, 13434 bp, Homo sapiens
  misc_feature (713)..(713): n is a, c, g, or t
  misc_feature (8735)..(8735): n is a, c, g, or t
ggtcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtgagcaggtgatcacagaagagggtggagaggtggggtggggtgggcattgctagtccataaaggtccttggtatgaattagaagaaggcactccttcctcaccntgaggggtgtggatgcagcccagaacacaacttggagagcagagctgggctacatgtcaaccaaagcatatgcgagggccctgagaggctgcatacattacacatactagcaactgggagcagacatggccttatgagatgaggctagcctggctaggggcctgacataggagcactacataggctcagcctctctcccaggagagagactgagacttgcctctcccctcctactccaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgtgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctaggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggaggaagagacccccagccccacggaactcagcactgaggcccnggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgga

SEQ ID NO: 375581 - DNA, 13545 bp, Homo sapiens
  misc_feature (713)..(713): n is a, c, g, or t
  misc_feature (8735)..(8735): n is a, c, g, or t
ggtcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtgagcaggtgatcacagaagagggtggagaggtggggtggggtgggcattgctagtccataaaggtccttggtatgaattagaagaaggcactccttcctcaccntgaggggtgtggatgcagcccagaacacaacttggagagcagagctgggctacatgtcaaccaaagcatatgcgagggccctgagaggctgcatacattacacatactagcaactgggagcagacatggccttatgagatgaggctagcctggctaggggcctgacataggagcactacataggctcagcctctctcccaggagagagactgagacttgcctctcccctcctactccaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgtgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctaggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggaggaagagacccccagccccacggaactcagcactgaggcccnggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggagtccatgatgccttcggcatgcatttgacatcgatccctttggaccgggatagagtccaaaaagataacgccatgtaggccatgcaccatatcggaataaaagcgcttttggaattgagctgtcggccaggccacttgctgaacttctgagcactggact

SEQ ID NO: 375582 - DNA, 13164 bp, Homo sapiens
  misc_feature (713)..(713): n is a, c, g, or t
  misc_feature (8735)..(8735): n is a, c, g, or t
ggtcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtgagcaggtgatcacagaagagggtggagaggtggggtggggtgggcattgctagtccataaaggtccttggtatgaattagaagaaggcactccttcctcaccntgaggggtgtggatgcagcccagaacacaacttggagagcagagctgggctacatgtcaaccaaagcatatgcgagggccctgagaggctgcatacattacacatactagcaactgggagcagacatggccttatgagatgaggctagcctggctaggggcctgacataggagcactacataggctcagcctctctcccaggagagagactgagacttgcctctcccctcctactccaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgtgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctaggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggaggaagagacccccagccccacggaactcagcactgaggcccnggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctactaccggggacggaaaaaaaaccccgagggggcctgagagggacaaggaaaacaggccaacctaagggccaaacactaaaacgggacaaataacggagaagcacaagagggaacc

SEQ ID NO: 375583 - DNA, 5629 bp, Homo sapiens
  misc_feature (713)..(713): n is a, c, g, or t
ggtcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtgagcaggtgatcacagaagagggtggagaggtggggtggggtgggcattgctagtccataaaggtccttggtatgaattagaagaaggcactccttcctcaccntgaggggtgtggatgcagcccagaacacaacttggagagcagagctgggctacatgtcaaccaaagcatatgcgagggccctgagaggctgcatacattacacatactagcaactgggagcagacatggccttatgagatgaggctagcctggctaggggcctgacataggagcactacataggctcagcctctctcccaggagagagactgagacttgcctctcccctcctactccaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacgggtgagatgggcccctacacagctgagcctgaggccacagccttcccacccttctcttcactccctctgctgagtcttccctttgtccacc

SEQ ID NO: 375584 - DNA, 235 bp, Homo sapiens
cctcgggacttggaggccaaggaagtgaccccccgcaccgccctgctcacttggactgagcccccagtccggcccgcaggctacctgctcagcttccacacccctggtggacagaaccaggtgccccggccccactgacccaactcccctccctgggtgattccaggaggtgctgcctctggccctcccggagggtctccacctccctctcccctgacccccccttgtctgtccc

SEQ ID NO: 375585 - DNA, 711 bp, Homo sapiens
caaccatgttctttgtcttcccaaatcccagctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacgggtgagatgggcccctacacagctgagcctgaggccacagccttcccacccttctcttcactccctctgctgagtcttccctttgtccacctgctctgtctcatttgaaaagccacatggggctagcacagtgactcatgcctgtaatcccagcactttgggagtccaaggcaggtcaggagtttgagaccagtctggccaacatggcaaaaccctgtctctactaaaaagacaaaaattagctgggtgtggtgatgggtgctagtaattccagctactcgggagtctgaggcacaagaatcacttgaacccaggaggtggaggctgcagggagctgagattgcgccactgcactccagcctgggtgataga

SEQ ID NO: 375586 - DNA, 13290 bp, Homo sapiens
  misc_feature (8591)..(8591): n is a, c, g, or t
ggtcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagaggaaagggaggaggagtccccgcccaggccaagcctgtcccagcccccacggcggccttggggcaacctgacggccgagctgagccgtttccgcggcacggtgcaggacctggagcgccacctgcgggctcacggctacccactgcgggccaaccagacttacacgtcggtggcgcgccacatccatgaatacttgcagcggcaggtgctgggcagttccgccgatggcgcgcttctcgtgtctctcgacgggctccgcggccagttcgagcgcgtggtgctgcgctggcggcctcagccgcctgcagagggccccggcggtgagctgactgtgccgggcaccacgcgcaccgtcagcctgcccgacctcaggcccggcaccacctaccacgtggaggtccacggggtgcgggcggggcagacctccaagtcctacgccttcatcaccaccacaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgtgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctaggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggaggaagagacccccagccccacggaactcagcactgaggcccnggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgga

SEQ ID NO: 375587 - DNA, 439 bp, Homo sapiens
cctgccgcccgtgtccacctctctcaccagctccttggcctctttccctccacgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgga

SEQ ID NO: 375588 - DNA, 9775 bp, Homo sapiens
  misc_feature (5076)..(5076): n is a, c, g, or t
gagatgtgaaagggcctggctgggctcccctctttctgaagctccctgctgctctggtttgtggttggaggcagagccacactagtccacgcagtgcttccatgccgtttgaaagaaggcacccattccttaaagtggacaccactcctcaccagggcacacagctcggcaagcagagtgctggctggatttcagtccctctgtactccctcagcaaatgcacttttgtgcagtgaacaacctgcacagcctcacacagcattcctatgtgggatttggcttccccattctccttggacctaagtctctcccttctctctacccactcttcctagtgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgtgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctaggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggaggaagagacccccagccccacggaactcagcactgaggcccnggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgga

SEQ ID NO: 375589 - DNA, 13396 bp, Homo sapiens
  misc_feature (713)..(713): n is a, c, g, or t
  misc_feature (8735)..(8735): n is a, c, g, or t
ggtcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtgagcaggtgatcacagaagagggtggagaggtggggtggggtgggcattgctagtccataaaggtccttggtatgaattagaagaaggcactccttcctcaccntgaggggtgtggatgcagcccagaacacaacttggagagcagagctgggctacatgtcaaccaaagcatatgcgagggccctgagaggctgcatacattacacatactagcaactgggagcagacatggccttatgagatgaggctagcctggctaggggcctgacataggagcactacataggctcagcctctctcccaggagagagactgagacttgcctctcccctcctactccaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgtgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctaggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggaggaagagacccccagccccacggaactcagcactgaggcccnggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgga

SEQ ID NO: 375590 - DNA, 4583 bp, Homo sapiens
  misc_feature (713)..(713): n is a, c, g, or t
ggtcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtgagcaggtgatcacagaagagggtggagaggtggggtggggtgggcattgctagtccataaaggtccttggtatgaattagaagaaggcactccttcctcaccntgaggggtgtggatgcagcccagaacacaacttggagagcagagctgggctacatgtcaaccaaagcatatgcgagggccctgagaggctgcatacattacacatactagcaactgggagcagacatggccttatgagatgaggctagcctggctaggggcctgacataggagcactacataggctcagcctctctcccaggagagagactgagacttgcctctcccctcctactccaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagaggaaagggaggaggagtccccgcccaggccaagcctgtcccagcccccacggcggccttggggcaacctgacggccgagctgagccgtttccgcggcacggtgcaggacctggagcgccacctgcgggctcacggctacccactgcgggccaaccagacttacacgtcggtggcgcgccacatccatgaatacttgcagcggcaggtgctgggcagttccgccgatggcgcgcttctcgtgtctctcgacgggctccgcggccagttcgagcgcgtggtgctgcgctggcggcctcagccgcctgcagagggccccggcggtgagctgactgtgccgggcaccacgcgcaccgtcagcctgcccgacctcaggcccggcaccacctaccacgtggaggtccacggggtgcgggcggggcagacctccaagtcctacgccttcatcaccaccacaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatctgtgagtgacagcagtaacaccctgccctctgtactgccctgaagaggttttctcagtgctttgggaacctgctttgggagctccgggaaggcttcctggaggcagtggtgcatgagctgaattctgaagggaaagtagtggtggggcaggcaaagagtttgagaagctcagtgcagcctgaggg

SEQ ID NO: 375591 - DNA, 345 bp, Homo sapiens
gccttctccatactggtaaggtggacacctgggtcttggtgatgtaggtgttgacactcaggagataaagagcctggtggaagttcgccaggggtcttttctgtcccccacgtagtccctcatgagctccttggtgggcacagctatgccttagactgcttctgggtgttcccaccccatcacctctccccactcaggcagaacccgttaggctaggatgcccagtaagtttgagataaaatggagttggcttgcaggtagggagttacaggaagaggcacgagcaccagggcttccctgttgccaaaatacacacaggaggaaggctgcctggcttcagctggc

SEQ ID NO: 375592 - DNA, 1800 bp, Homo sapiens
cattcgtgtcccctaaatctataaataataatataataaacaaaatacaagccctgaattggaaatgggagatggataccaaggcttgagtcctcagaacttagcttttcttggcctttacctctggagcaagagcccagctggtgcttttctttgctgttgcttctcagttccctctcctcaccctgggtggggtctctctcaggggtgttcattgcccgtataccttagtacttggcctagtgatcaaagcaccagtcctgggttccatgtctcatcaccagatggggctggtgaccaccccacatggtgctgtgagagttaaatggggagtatgtgtagtgcacttagcatagtagattgcaccagacatatcttccaacagtagctattgttattcactagtggagagtagaatgaggccctggggagggtgagagcagttctctaagaagtgtggaagtctaaaccgcagatgtggccaggaggaccctcccaatccacacactggcctccctgccccttcctgtatcagtgccaactttgtcctgtgcatcaaaaccctgactccatttcatgggttgctactgctcatttggctgcgggaaggccccgcttctgaaaataaaattgcctgtcagagaaaccctaaggatcaggattccggatctgggcagggcatggacaagttgggtggcagtggcaaaagcccctccccatggtctgccttttcccccagaagcaagttgctgggactgttgcataaaatggctcccacctccagtgcccagacagcctgcgctggggtgaagctggctacacgtgcactgaagctggcaggcttggggagaggtgagctgaggccaggtatctgcttcctttgcccaggattttgatggtctctcccctacacccacagtgggtgtgaacaacaaagacccaatctttgatggtggtgaggattcctctgcacacgctcacactcacgttctctacccccttcttttcaacgtggcccacagcacgattccagaccctgctctattgtgctcagaggaagcagctgctggctccagcccgaatttgggagtgctttgatatgcagccctctctggggccctgccagtactgactctagatgagccctctgcggctgctgggctcacaaatcagccttctcaccccttcctccaggagcagtgttggatgagaatctcccccttacacacatagatcctgtgtttgttttgtctgcttttgtttgtttgtttgtttttgttttcctgttctgttcaattttataaggaggcatagcttttggacttggttgcagggttgggtttggaacttaataataccttggattgacaaaggcgccttttcttctaaagaacacaaaccttgatggttcttgcctgggtgtggttctcacctgggtgagcctggctgtgagggtagggggcctgaggtcaccccaaccacagcttctgtggtcctactggcagcatgttctagacagacctgtgtggagctggggaaaggagagtggagaagtttgaggaagctgcatgtttatgttttgtgttcctccctcccccaggttggggtcagcgggactttatttggatccaccacaggtcttttcaaccaaagccttgcagaaacaggctttaccccatacacacagaagagcaacgacttccttgttaagagtctgaaaatctgggtgagagcctgtcagacccatggcctcagagagcaggaaaaatcctttgcaactgggaaggaaattcagaagac

SEQ ID NO: 375593 - DNA, 86 bp, Homo sapiens
gtttctggactgagcacctgggtggacagtggagctgtacaccaacatatggactcctggagaggactggattgagaaggagtgtg

SEQ ID NO: 375594 - DNA, 426 bp, Homo sapiens
gactcagaaagagcactcatgaaaaaactaacccagtgtcactgttttggaatagacaaagatttcttaagattgtgaagatattctcaagtatattcatctagatgctttactgttccactttttgtatcttagtcagttttactcagtgtgtatgtggtgtgaggccaggtcagttaggaaactcaatttaaaatgatatttatattatccagaaacatcaaatgaatctaaagaaagatctgtaaaacctctacatacaaagtaaaatattgctgaaagaattaaagaaaagttaaataaatgtgggatatatcattacaatatttgagtttcccccacattgacccagtgattcaatgtagttccaaataaaatctcagcaggattgtgtgtgtatgtataaattgagaagttgattcaaaa

SEQ ID NO: 375595 - DNA, 855 bp, Homo sapiens
aaattaaagttttgaaagtaggtttttcctgttagatggattcattcttgactcagaaccaaatcctatggatatgtaagatgtgtgcacgtcccagtgtttgtaacctgagaattttatttaaaccgtcatttgaatctacagtaatctggtgttggggaggaataggatctttatcaacaaagagctgccaaaaccccaactgcttcttgagtagctgtaatagatgaataatgttacagccaaccatgcatttcaagttttgctcaaaaggcttttcaactaatgctggtggtattccatatccgtgtgttcatctcagagtgcagtagtttccatctgattttcattacctttcttgagaggatcaactttacaaccggaatcagaaaagcagtcaaagtcattgcaagtggcaatcagtgaaatataacaatttgagcttgggaacatatgtttcattataaagaaaaaaaaaatggttaccccgtaattccaagattcatatttcccagggtagaagggatcatgcacaagttctagtgtaccttcccatatcatgctgacattcctataaagtgcttgttctcccctacagatagccaactcatgaccttccaaggaaacttaactccctttttgattctgaccatttgaaaatgctttattgtatttgagatgaaattcatgtttctgtagttaaatctttcagaatttaaaacttggaactcaacagagtaaatctaaacctctcttcttctcacaggcagctcttatcccaattcctaccatttcctttgctaggctataatatgcattctttctcttatggagtagctttcattcccttaatca

SEQ ID NO: 375596 - DNA, 9518 bp, Homo sapiens
  misc_feature (1440)..(1440): n is a, c, g, or t
  misc_feature (1554)..(1554): n is a, c, g, or t
  misc_feature (6238)..(6238): n is a, c, g, or t
  misc_feature (6477)..(6477): n is a, c, g, or t
  misc_feature (6544)..(6545): n is a, c, g, or t
  misc_feature (6550)..(6550): n is a, c, g, or t
  misc_feature (6560)..(6560): n is a, c, g, or t
  misc_feature (6631)..(6631): n is a, c, g, or t
  misc_feature (6635)..(6635): n is a, c, g, or t
  misc_feature (6645)..(6645): n is a, c, g, or t
cgatgggccctactccaaaggaggcaaggacgcaggaggggccgacgtttccctggcgtgccgcagacagagcattccagaggagttccgagggatcactgtggtggagctgatcaagaaagaaggcagcacgctgggcctgactatctcaggtggcaccgacaaggatggaaagcccagggtctccaacctgagacctgggggacttgcagccaggagtgatctgctgaacattggtgactatattcggtctgtgaacgggatccacctgaccaggctccgccacgatgagatcatcaccctgctcaagaatgtgggcgagcgcgtggtgctggaggtggagtatgagctgcccccgcccgctcctgagaataaccccaggatcatttcaaagacagtggacgtctccctctacaaggagggcaatagctttggctttgtccttagaggaggtgcccatgaagatgggcacaagtcccgcccgcttgtcctgacctacgtgcggcccggtggccctgccgacagggagggctccctgaaggtgggcgacaggctgctcagcgtcgatggaatcccgctgcacggggccagccatgccaccgccctggccaccctgcggcagtgcagccacgaggcactctttcaggtggagtatgatgtggccacccctgacacggtggctaatgcttcgggacccttgatggtggaaatagtcaagacgccagggtctgccctggggatctcgctcaccaccacctccctccggaacaagtcagtcattaccatcgaccgcatcaagccagccagcgtggtggacaggagcggagccctgcaccctggagaccacatcctgtccatcgatggcaccagcatggaacactgctcgctgcttgaggccaccaagctcctggccagcatttcagagaaggtgcggctggagatcctgcctgtgccccagagtcagcggccactgaggcctcagaggcagtgaaagtgcagaggagtgagcagctgcaccgctgggacccctgcgtgccctcctgccacagcccccggcccggccactgcaggatgcccacctgggccacacctgctggccaggaccaaagccgatccttgtcttcaactcccttttcctcgccgaccttgaaccacgccttttcctgcaacaaccccagcacccttccccgtggatcccagcccatgagtcctcgaactacaatggggcggaggaggcagcgaagaagggaacacaagagctcgttgtcgctagcctccagcacggtggggccgggcgggcagattgtgcacacggagaccacggaggtcgtgctctgtggagaccccctcagcggctttggcctccagctccagggcggcatcttcgccaccgagaccctgtcctccccacccctcgtgtgcttcatcgagcctgacagnccggctgagaggtgtgggctgctgcaggtgggggaccgtgtcctgtccatcaatggcattgccaccgaggacgggactatggaggaagccaaccagctcctgcgggacgccgcnctggcccacaaggtcgtgctggaggtggagttcgatgtggcggagtccgtcatcccaagcagtggcaccttccacgtgaagctgcccaagaagcgcagcgtggagctgggcatcaccatcagctcggccagcaggaaacgaggggagcccttgatcatctccgacatcaagaaaggcagcgtggcacacaggacgggcaccctggagccaggcgacaagctactggccattgacaatatccgcctggacaactgccccatggaggacgccgtgcaaatcctgcggcagtgcgaggacctggtgaagctgaagatccggaaggacgaggacaactctgatgagctggagaccacaggtgccgtcagttacacagtggagctgaagcgctacgggggtcccctgggcatcaccatttcgggcacggaggaaccttttgaccccattgtcatctcaggcctcaccaagcgtggcctggctgagaggactggtgccatccacgtgggggaccgcattctggccatcaacaacgttagcctcaagggccggccgctgagcgaggccatccacctcctgcaggtggctggagagaccgtcacactgaagatcaagaagcaactagaccgtcccctcctaccccgcaagtcgggcagcctcagtgagaccagtgatgctgatgaggacccagcagatgccctgaaaggaggcctgccagcagcccgcttctcgccggctgtgcccagtgtggacagtgctgtggagtcttgggacagctcggccaccgagggtggctttgggggcccagggtcctatacaccacaggcagcagcccggggcacgaccccccaggagcggaggcctggctggctgaggggcagccccccacccaccgagccccggaggacgagctataccccaaccccagctgacgagagctttccagaggaggaggaggaggatgattgggagccgccaacgagcccagcccctggccctgcccgagaggagggcttctggcgcatgtttggagaagctctcgaagacctggagtcatgtggtcagtcagagctgctgagggaactggaggcatccatcatgacgggcaccgtgcagagggtggccctcgagggcaggcctggccaccggccttggcagaggggccgggaggtacgagcctctcctgcagaaatggaggagctgttgctgcctacacccttggagatgcacaaggtgaccctgcacaaggaccccatgcggcatgactttggtttcagcgtctcagatggcctcctggaaaaaggtgtctatgtccacactgtgcgccctgatgggccagcccaccgtggaggcctccagcccttcgacagggtcctgcaggtcaaccacgtccgtacacgggacttcgactgctgcctggcggtgccactcctggccgaggcgggtgatgtcttggagctgatcatcagccgcaagccgcacacggcacacagcagccgggccccccgatcgccaggccccagcagtccccggatgctctgaagtcagcatgtgggccgaactcctaaggggccacccaggcagatcctggctcccagacacgtagctgggctggagaagcggccacccactcattcatctgttggtctggcagactctgagcctgggatgatgcttggtctctgttccccaggtctgtggtgactggggtgccaggcagggaggtcctgccctagttggagtgacagctggggtctctcgccaagttgggtctccaagatgcccagaggagcctcccttaagaagggttggcacaggctgctcagccgagaggagagaggcctgggggctgtcccaggtctctgtggggcctccttggagaggtcgaagatgtagggagcacttcctcccagcaaagccatggagctggaatgagctgcaaggaggagtgagttctcggtcacaggaggtgagcaggcaggagctggataccccagcgcagtcatgcattggggtatgaggcattcccatgatgcgtgcacacgcgcttgggggttggcttcctgatggggagccacttcatctagagactcggccaccaggaaggatgctgcttcggatgggagcccagctccttcgcttctccagaataggggtttggggcttgctagtcctgagattctgagattcccagaatctggtccccacttatgagactcttaagttggggcgtctgggatcccaggaagtgctggccctttgattctgaaagtgggtgattctttgatttcagcatctcagtctgaagcttctgggacttgagactgtggttctgggcccattgggcaggctctatgggccttgggctctcagccctcctgcttcttctgtaggccgtgtggccactgacccatctgcacgtccgctcagcccaagcccctccatgtgggaggggtcattttggggcaaaagaccctggagcttccattcacctgccatccagtgaaaattgaaaagcgatggacgcaggacctgtgaggcggtagcgctcctctttacagccagatcagtggaggaagaggagaaagagggagggagatgggagagaaatgggccagagaaaaagatgggacactcttgcccagtggagggtgtccaaagtgcttattcaaagaagtctattcccacttgaaatctggaagcaccagcatcccttaaaatcattgtcctcagtgtccacaaatcagagaccctcttcattttgagaagggtgtgggcctcccctggtggtctagtgagtggtgcctgggatggagtgggcgggcaggtgtagccagggctggggatgtgctttgcctggcccagttctcacaggggtctcaggaaaacggggcacccactcccacctccatctgtctccaacctggggtccctggaggccagaaaagtgctcttccatttgagggaacagatgaggagtcaagaggtctgttcttttcaccctgggtctgttacctgtttgctgtgtgaccctgtctgggttggacccccagcccctctggacgatcacgggtggacagtctgagcagacacaggcctcctggtcagggccggaaccatctctgccgacccaccaaggcccccttggggacctgcccacgctgtctcctggaggcctgcctcccttacccctcccctccacttcgctgggctctgccccttggtgccctccctgagggccctgcatgcttgtgcctggggtgctcagcgcctctgctatcttggattcccgtgtactcagcccagagtgaaagggcactgtctacctgtcacagggcaccaagtgaaagccaagagccctcacttttgagggtgagggacagcacagcagaggtgtggcttctggatgcaagcagccatagctgtgtgaccttggacaggtggctcagcctctctggacctctgctaagcaacagggctggacaggacacactctcagggcctctcggcttgggaaaactgcattgactccaggactccaggcgagggaagatgcacccgactctaactaatacccccctccctcctcgggctgaggcctctgccattctcccaaaagtatgcaatcaggcccgcggtgggcctcccagccatgccggcctcctcatatgcaatatttcttctggcttctcatggggatggttcatccccgacttgaaatttcctgacacctttccccagtgagcgccctgcctgcctatgcattttgggaacagcccctgtgacatgtccccttccacctgccctctcccccaaagctgtatttttctctggctgagattagaacacattccttgtaaagtatttttctacatcgggttttcttagggctctcgggaagcacaaggggctgtattgcaaaggccgcttatggtctgtttggggccctcgtctaagtctttgtcccaccaggggttgcagtggcttgggggtaggtgccatggggatgattttttaaaataaaattatttaaatccacctagagtagaagtttgctttttaaaaaaatcatggattggcaagagtcagcttctgtatgggtctggtgacatctcacctgcttttgatgattcattaattcaaaaagtttgccatttgcttccatcatccagcccctgggcaacatgaatcagacagatttaggtcatgtctgcacattctggtggcaggcagacaatcaacaagtaagcaaataaataattatttcaaaaggcatcaagtgcaacaaagaaaacaagggagtaacgggatagagggaccagggtgaggggctttagctcacaatattaggaggggtttctctcaagaggcgacatttgcaatgagacctgaagacaggagccagcctccatggagacctggaggaagagtgtctcaggcagcgggcacagctagtgcaaaggccctgagataggaacgagtttgacggtctcaaggaagagaaagaaggcctgggaggggaatggggctggagactaggttggaggtagcaggaatcagtcgtgaaggcttgggtagggggagcaaatttgattctctgcgcagcagaaagccagaggcaggcagtggtgcctgcatatggagtctctttagcccaggttgggaaggtagtggcaggagggcagcctcnggtctggctgctgccctggagtgtccagagagtgtctagggcaggtgagctacagggtctgggacccagaggccagggccaggccccactggggaggccacagttctgtgagcagaggaagagcttctttccaggaagcgagtactctgtcttgggagtggtgtaggcagggggaaggccaagggaggcagcaggccttgctctaagcgctttgcaagagcttgctggatcctcccaanagcctttggaggtgggctctattcctgtcccatcattacagatgaggaaacaggcacagagaggttnngtaanttgcccaagnccacacaggtagtaagggatggaaccagggcttgaacacaagccacatggccagtacacatagagagaggnaggnaggtaggcanaggctgtcagaaagagccagaaaatgggggtagggtggtcttctattctaacattgtctataaatgagttactgagaattttgtctggttagttgggcaaagggctcaactgactcccgagtttgtccatcccaaagggtggggggcgctgttggcaggaaggctgccccaaacatggacctgttgtgaccccagagagcccctaactgggtattaatgagcgcctgcacctgacggtgggggagtgggagaagggcaatcaggtttgctccccctctaccctttcccccactccgccacccgctttctgcccttctggcaggtcagcccaaggctaaagaggagggactgaaagccgcagcaggtgagcacctaaggccaagagcatcacctccaatcatcctggtggccttgatggggacaatggtttattccagatggggaaactgaggctcaggtgactgctgccagatctcccagctgtacagggctgggcatgtagcaggtagaatcagtagagccagtagagccaagagctcatgggcccgggtgcgaatccaggttctttcatggacttgctgtgtacccctgagtgagcaagctgcttcctctgtgagcctccatgtgggaacctctaacctgggaaaatacctacctttgaggagcgtcctgggattggacgggaagccctttataaaatgtaaagcgtttggcaaacgttgagggggaaatacctcaccagaacacaacccacacatgttggatgttaaaaaggaaatgtttattttcatgttataaggtgattacaaactcctctaaaaaaagcaaagatgaatttaaaatattgatatacatatttatctaaaaagcaaaagagaaaaaaacccctgcaaaatacagggaatcatatcataaaacatttatacacaaaagcttgtatactgcaagactgaactacacaccaaggatcttgttcaaatacaaatgttcctcctcagaaaagtctcttgttggttgattttttttttataaaagtttaaaatatcttaaaaatattttgaagttttaaaaaaatgtcctgatgagccagacatatttctggaaggaggcaagacccacattctcagctttctcttgtgctaaatacagagtcacagttgctagggattgggagattaattgggtaaaaaaaaaaaatgaagccaacatctcaatttgaagtcaaatatataacaggatgctccatccctcggagaacacgccagaacatgtctgtagtgacacccacaagagaacaatgcaaaaatgcttcctattacaacaatatatattctgaggatcagggagagaaggaaagggggagggctgccccctgctttctggactgcccacctctacaagtttggctctctgggtttgttttgtttagtcttgtggttttgtacttcgatttttgcacacagtggtatttaccgtgtcccagacagcctggcctgggaccacatgggtctgagggagggatgggacctcaggccaccttgaaggattttctcttgggtcctttcctggcttgtgtctgaatcttgggtggggtgggctgcggggagcagttaggtgcctctgcctttagactggctacccagagcatttccccagggagaggggctgtgctgggagatgctggctgggtgggggaccagtgtggcggtacccgggtgatacaagagtgccctgaagtgggctggaggggccatgctgtgctctccccttgtgtttccccactgtctttgggggtatgctggggatccagggggcagtgaaggagctgcacatggcccaggggttatgctgtcctggaaggagagcatccaaggccacttcctgctgcctggaaactccccgcagagcctcggggtcagtctggagccagggcgacttcatctaaatcctgcctaaggatctggcacacctctggcttctctgcacctcagttccctctttcacaaacagggatctcaattcctagctcaccaagggctgctgggaggaaggagggccccgtgcagggctggggtgtgcaggtgaggctggagtcacccagctcacggagccaccgcatgggtccaggaattctgtgaggatggtgggagtgtggctgctgctgctcccctcatccctgaacatggaggggagcgcatttccttttccataaaggcttgtctttggttgtcaggaagaccttgaggatgttgctggatgtagccctggttagacactcaccattccctgcacctacctcggagaacctgcagctagagctgtttcaagaaaatccattcctggctcacagtgcctccctgagcctcagttacctcatttacaacaagggcgttgggttaggggaccctggaggcccttctctccctgaccgtcaggaaatctctgtggccctagcatggcccatctcaacgcagtgtctcccacttcttcatcttaaaaaattgatttaaacaaccccctcgcttcctttccagatctggctggctgggctatgtgcgggcatcagcatttctgacccatcccaagcagaaagcaggtgaaggactttgcccattctctatagacaggtggaccagagtcatgagctctcatggaaagtttcgtttatacggagacatgaaggttgagcattattacacaggtactcgcagagctatgctctgcacacagagccagggctggctgggcgagagggctctgattggagacaggtgccttggggagagttgaggaacgacttccttccaggcggggcctggggacttggtctgcctgtgtctttggtctagaatttggtctgagaatcttataag

SEQ ID NO: 375597 - DNA, 9348 bp, Homo sapiens
  misc_feature (1440)..(1440): n is a, c, g, or t
  misc_feature (1554)..(1554): n is a, c, g, or t
  misc_feature (6238)..(6238): n is a, c, g, or t
  misc_feature (6477)..(6477): n is a, c, g, or t
  misc_feature (6544)..(6545): n is a, c, g, or t
  misc_feature (6550)..(6550): n is a, c, g, or t
  misc_feature (6560)..(6560): n is a, c, g, or t
  misc_feature (6631)..(6631): n is a, c, g, or t
  misc_feature (6635)..(6635): n is a, c, g, or t
  misc_feature (6645)..(6645): n is a, c, g, or t
cgatgggccctactccaaaggaggcaaggacgcaggaggggccgacgtttccctggcgtgccgcagacagagcattccagaggagttccgagggatcactgtggtggagctgatcaagaaagaaggcagcacgctgggcctgactatctcaggtggcaccgacaaggatggaaagcccagggtctccaacctgagacctgggggacttgcagccaggagtgatctgctgaacattggtgactatattcggtctgtgaacgggatccacctgaccaggctccgccacgatgagatcatcaccctgctcaagaatgtgggcgagcgcgtggtgctggaggtggagtatgagctgcccccgcccgctcctgagaataaccccaggatcatttcaaagacagtggacgtctccctctacaaggagggcaatagctttggctttgtccttagaggaggtgcccatgaagatgggcacaagtcccgcccgcttgtcctgacctacgtgcggcccggtggccctgccgacagggagggctccctgaaggtgggcgacaggctgctcagcgtcgatggaatcccgctgcacggggccagccatgccaccgccctggccaccctgcggcagtgcagccacgaggcactctttcaggtggagtatgatgtggccacccctgacacggtggctaatgcttcgggacccttgatggtggaaatagtcaagacgccagggtctgccctggggatctcgctcaccaccacctccctccggaacaagtcagtcattaccatcgaccgcatcaagccagccagcgtggtggacaggagcggagccctgcaccctggagaccacatcctgtccatcgatggcaccagcatggaacactgctcgctgcttgaggccaccaagctcctggccagcatttcagagaaggtgcggctggagatcctgcctgtgccccagagtcagcggccactgaggcctcagaggcagtgaaagtgcagaggagtgagcagctgcaccgctgggacccctgcgtgccctcctgccacagcccccggcccggccactgcaggatgcccacctgggccacacctgctggccaggaccaaagccgatccttgtcttcaactcccttttcctcgccgaccttgaaccacgccttttcctgcaacaaccccagcacccttccccgtggatcccagcccatgagtcctcgaactacaatggggcggaggaggcagcgaagaagggaacacaagagctcgttgtcgctagcctccagcacggtggggccgggcgggcagattgtgcacacggagaccacggaggtcgtgctctgtggagaccccctcagcggctttggcctccagctccagggcggcatcttcgccaccgagaccctgtcctccccacccctcgtgtgcttcatcgagcctgacagnccggctgagaggtgtgggctgctgcaggtgggggaccgtgtcctgtccatcaatggcattgccaccgaggacgggactatggaggaagccaaccagctcctgcgggacgccgcnctggcccacaaggtcgtgctggaggtggagttcgatgtggcggagtccgtcatcccaagcagtggcaccttccacgtgaagctgcccaagaagcgcagcgtggagctgggcatcaccatcagctcggccagcaggaaacgaggggagcccttgatcatctccgacatcaagaaaggcagcgtggcacacaggacgggcaccctggagccaggcgacaagctactggccattgacaatatccgcctggacaactgccccatggaggacgccgtgcaaatcctgcggcagtgcgaggacctggtgaagctgaagatccggaaggacgaggacaactctgatgagctggagaccacaggtgccgtcagttacacagtggagctgaagcgctacgggggtcccctgggcatcaccatttcgggcacggaggaaccttttgaccccattgtcatctcaggcctcaccaagcgtggcctggctgagaggactggtgccatccacgtgggggaccgcattctggccatcaacaacgttagcctcaagggccggccgctgagcgaggccatccacctcctgcaggtggctggagagaccgtcacactgaagatcaagaagcaactagaccgtcccctcctaccccgcaagtcgggcagcctcagtgagaccagtgatgctgatgaggacccagcagatgccctgaaaggaggcctgccagcagcccgcttctcgccggctgtgcccagtgtggacagtgctgtggagtcttgggacagctcggccaccgagggtggctttgggggcccagggtcctatacaccacaggcagcagcccggggcacgaccccccaggagcggaggcctggctggctgaggggcagccccccacccaccgagccccggaggacgagctataccccaaccccagctgacgagagctttccagaggaggaggaggaggatgattgggagccgccaacgagcccagcccctggccctgcccgagaggagggcttctggcgcatgtttggagaagctctcgaagacctggagtcatgtggtcagtcagagctgctgagggaactggaggcatccatcatgacgggcaccgtgcagagggtggccctcgagggcaggcctggccaccggccttggcagaggggccgggaggtacgagcctctcctgcagaaatggaggagctgttgctgcctacacccttggagatgcacaaggtgaccctgcacaaggaccccatgcggcatgactttggtttcagcgtctcagatggcctcctggaaaaaggtgtctatgtccacactgtgcgccctgatgggccagcccaccgtggaggcctccagcccttcgacagggtcctgcaggtcaaccacgtccgtacacgggacttcgactgctgcctggcggtgccactcctggccgaggcgggtgatgtcttggagctgatcatcagccgcaagccgcacacggcacacagcagccgggccccccgatcgccaggccccagcagtccccggatgctctgaagtcagcatgtgggccgaactcctaaggggccacccaggcagatcctggctcccagacacgtagctgggctggagaagcggccacccactcattcatctgttggtctggcagactctgagcctgggatgatgcttggtctctgttccccaggtctgtggtgactggggtgccaggcagggaggtcctgccctagttggagtgacagctggggtctctcgccaagttgggtctccaagatgcccagaggagcctcccttaagaagggttggcacaggctgctcagccgagaggagagaggcctgggggctgtcccaggtctctgtggggcctccttggagaggtcgaagatgtagggagcacttcctcccagcaaagccatggagctggaatgagctgcaaggaggagtgagttctcggtcacaggaggtgagcaggcaggagctggataccccagcgcagtcatgcattggggtatgaggcattcccatgatgcgtgcacacgcgcttgggggttggcttcctgatggggagccacttcatctagagactcggccaccaggaaggatgctgcttcggatgggagcccagctccttcgcttctccagaataggggtttggggcttgctagtcctgagattctgagattcccagaatctggtccccacttatgagactcttaagttggggcgtctgggatcccaggaagtgctggccctttgattctgaaagtgggtgattctttgatttcagcatctcagtctgaagcttctgggacttgagactgtggttctgggcccattgggcaggctctatgggccttgggctctcagccctcctgcttcttctgtaggccgtgtggccactgacccatctgcacgtccgctcagcccaagcccctccatgtgggaggggtcattttggggcaaaagaccctggagcttccattcacctgccatccagtgaaaattgaaaagcgatggacgcaggacctgtgaggcggtagcgctcctctttacagccagatcagtggaggaagaggagaaagagggagggagatgggagagaaatgggccagagaaaaagatgggacactcttgcccagtggagggtgtccaaagtgcttattcaaagaagtctattcccacttgaaatctggaagcaccagcatcccttaaaatcattgtcctcagtgtccacaaatcagagaccctcttcattttgagaagggtgtgggcctcccctggtggtctagtgagtggtgcctgggatggagtgggcgggcaggtgtagccagggctggggatgtgctttgcctggcccagttctcacaggggtctcaggaaaacggggcacccactcccacctccatctgtctccaacctggggtccctggaggccagaaaagtgctcttccatttgagggaacagatgaggagtcaagaggtctgttcttttcaccctgggtctgttacctgtttgctgtgtgaccctgtctgggttggacccccagcccctctggacgatcacgggtggacagtctgagcagacacaggcctcctggtcagggccggaaccatctctgccgacccaccaaggcccccttggggacctgcccacgctgtctcctggaggcctgcctcccttacccctcccctccacttcgctgggctctgccccttggtgccctccctgagggccctgcatgcttgtgcctggggtgctcagcgcctctgctatcttggattcccgtgtactcagcccagagtgaaagggcactgtctacctgtcacagggcaccaagtgaaagccaagagccctcacttttgagggtgagggacagcacagcagaggtgtggcttctggatgcaagcagccatagctgtgtgaccttggacaggtggctcagcctctctggacctctgctaagcaacagggctggacaggacacactctcagggcctctcggcttgggaaaactgcattgactccaggactccaggcgagggaagatgcacccgactctaactaatacccccctccctcctcgggctgaggcctctgccattctcccaaaagtatgcaatcaggcccgcggtgggcctcccagccatgccggcctcctcatatgcaatatttcttctggcttctcatggggatggttcatccccgacttgaaatttcctgacacctttccccagtgagcgccctgcctgcctatgcattttgggaacagcccctgtgacatgtccccttccacctgccctctcccccaaagctgtatttttctctggctgagattagaacacattccttgtaaagtatttttctacatcgggttttcttagggctctcgggaagcacaaggggctgtattgcaaaggccgcttatggtctgtttggggccctcgtctaagtctttgtcccaccaggggttgcagtggcttgggggtaggtgccatggggatgattttttaaaataaaattatttaaatccacctagagtagaagtttgctttttaaaaaaatcatggattggcaagagtcagcttctgtatgggtctggtgacatctcacctgcttttgatgattcattaattcaaaaagtttgccatttgcttccatcatccagcccctgggcaacatgaatcagacagatttaggtcatgtctgcacattctggtggcaggcagacaatcaacaagtaagcaaataaataattatttcaaaaggcatcaagtgcaacaaagaaaacaagggagtaacgggatagagggaccagggtgaggggctttagctcacaatattaggaggggtttctctcaagaggcgacatttgcaatgagacctgaagacaggagccagcctccatggagacctggaggaagagtgtctcaggcagcgggcacagctagtgcaaaggccctgagataggaacgagtttgacggtctcaaggaagagaaagaaggcctgggaggggaatggggctggagactaggttggaggtagcaggaatcagtcgtgaaggcttgggtagggggagcaaatttgattctctgcgcagcagaaagccagaggcaggcagtggtgcctgcatatggagtctctttagcccaggttgggaaggtagtggcaggagggcagcctcnggtctggctgctgccctggagtgtccagagagtgtctagggcaggtgagctacagggtctgggacccagaggccagggccaggccccactggggaggccacagttctgtgagcagaggaagagcttctttccaggaagcgagtactctgtcttgggagtggtgtaggcagggggaaggccaagggaggcagcaggccttgctctaagcgctttgcaagagcttgctggatcctcccaanagcctttggaggtgggctctattcctgtcccatcattacagatgaggaaacaggcacagagaggttnngtaanttgcccaagnccacacaggtagtaagggatggaaccagggcttgaacacaagccacatggccagtacacatagagagaggnaggnaggtaggcanaggctgtcagaaagagccagaaaatgggggtagggtggtcttctattctaacattgtctataaatgagttactgagaattttgtctggttagttgggcaaagggctcaactgactcccgagtttgtccatcccaaagggtggggggcgctgttggcaggaaggctgccccaaacatggacctgttgtgaccccagagagcccctaactgggtattaatgagcgcctgcacctgacggtgggggagtgggagaagggcaatcaggtttgctccccctctaccctttcccccactccgccacccgctttctgcccttctggcaggtcagcccaaggctaaagaggagggactgaaagccgcagcaggtgagcacctaaggccaagagcatcacctccaatcatcctggtggccttgatggggacaatggtttattccagatggggaaactgaggctcaggtgactgctgccagatctcccagctgtacagggctgggcatgtagcaggtagaatcagtagagccagtagagccaagagctcatgggcccgggtgcgaatccaggttctttcatggacttgctgtgtacccctgagtgagcaagctgcttcctctgtgagcctccatgtgggaacctctaacctgggaaaatacctacctttgaggagcgtcctgggattggacgggaagccctttataaaatgtaaagcgtttggcaaacgttgagggggaaatacctcaccagaacacaacccacacatgttggatgttaaaaaggaaatgtttattttcatgttataaggtgattacaaactcctctaaaaaaagcaaagatgaatttaaaatattgatatacatatttatctaaaaagcaaaagagaaaaaaacccctgcaaaatacagggaatcatatcataaaacatttatacacaaaagcttgtatactgcaagactgaactacacaccaaggatcttgttcaaatacaaatgttcctcctcagaaaagtctcttgttggttgattttttttttataaaagtttaaaatatcttaaaaatattttgaagttttaaaaaaatgtcctgatgagccagacatatttctggaaggaggcaagacccacattctcagctttctcttgtgctaaatacagagtcacagttgctagggattgggagattaattgggtaaaaaaaaaaaatgaagccaacatctcaatttgaagtcaaatatataacaggatgctccatccctcggagaacacgccagaacatgtctgtagtgacacccacaagagaacaatgcaaaaatgcttcctattacaacaatatatattctgaggatcagggagagaaggaaagggggagggctgccccctgctttctggactgcccacctctacaagtttggctctctgggtttgttttgtttagtcttgtggttttgtacttcgatttttgcacacagtggtatttaccgtgtcccagacagcctggcctgggaccacatgggtctgagggagggatgggacctcaggccaccttgaaggattttctcttgggtcctttcctggcttgtgtctgaatcttgggtggggtgggctgcggggagcagttaggtgcctctgcctttagactggctacccagagcatttccccagggagaggggctgtgctgggagatgctggctgggtgggggaccagtgtggcggtacccgggtgatacaagagtgccctgaagtgggctggaggggccatgctgtgctctccccttgtgtttccccactgtctttgggggtatgctggggatccagggggcagtgaaggagctgcacatggcccaggggttatgctgtcctggaaggagagcatccaaggccacttcctgctgcctggaaactccccgcagagcctcggggtcagtctggagccagggcgacttcatctaaatcctgcctaaggatctggcacacctctggcttctctgcacctcagttccctctttcacaaacagggatctcaattcctagctcaccaagggctgctgggaggaaggagggccccgtgcagggctggggtgtgcaggtgaggctggagtcacccagctcacggagccaccgcatgggtccaggaattctgtgaggatggtgggagtgtggctgctgctgctcccctcatccctgaacatggaggggagcgcatttccttttccataaaggcttgtctttggttgtcaggaagaccttgaggatgttgctggatgtagccctggttagacactcaccattccctgcacctacctcggagaacctgcagctagagctgtttcaagaaaatccattcctggctcacagtgcctccctgagcctcagttacctcatttacaacaagggcgttgggttaggggaccctgggaagttgtatgaaattaggacatggacggggtggggctgggggctcagcatgtaaaataacaaaaccaactgatgaccaccctccaagtaaactgtgcagggccggggaagggtggagaggtcggaaaggtggactttgaggatcctgggagcctgagggaatcccataacccaagccactgcaattaaagctacagacccaggacctcaagcagccatggccaagtcccagaatcgaggcacctgagagattgcagattctagcaactgaaggccccatgattctcaggttc

SEQ ID NO: 375598 - DNA, 5867 bp, Homo sapiens
  misc_feature (1440)..(1440): n is a, c, g, or t
  misc_feature (1554)..(1554): n is a, c, g, or t
cgatgggccctactccaaaggaggcaaggacgcaggaggggccgacgtttccctggcgtgccgcagacagagcattccagaggagttccgagggatcactgtggtggagctgatcaagaaagaaggcagcacgctgggcctgactatctcaggtggcaccgacaaggatggaaagcccagggtctccaacctgagacctgggggacttgcagccaggagtgatctgctgaacattggtgactatattcggtctgtgaacgggatccacctgaccaggctccgccacgatgagatcatcaccctgctcaagaatgtgggcgagcgcgtggtgctggaggtggagtatgagctgcccccgcccgctcctgagaataaccccaggatcatttcaaagacagtggacgtctccctctacaaggagggcaatagctttggctttgtccttagaggaggtgcccatgaagatgggcacaagtcccgcccgcttgtcctgacctacgtgcggcccggtggccctgccgacagggagggctccctgaaggtgggcgacaggctgctcagcgtcgatggaatcccgctgcacggggccagccatgccaccgccctggccaccctgcggcagtgcagccacgaggcactctttcaggtggagtatgatgtggccacccctgacacggtggctaatgcttcgggacccttgatggtggaaatagtcaagacgccagggtctgccctggggatctcgctcaccaccacctccctccggaacaagtcagtcattaccatcgaccgcatcaagccagccagcgtggtggacaggagcggagccctgcaccctggagaccacatcctgtccatcgatggcaccagcatggaacactgctcgctgcttgaggccaccaagctcctggccagcatttcagagaaggtgcggctggagatcctgcctgtgccccagagtcagcggccactgaggcctcagaggcagtgaaagtgcagaggagtgagcagctgcaccgctgggacccctgcgtgccctcctgccacagcccccggcccggccactgcaggatgcccacctgggccacacctgctggccaggaccaaagccgatccttgtcttcaactcccttttcctcgccgaccttgaaccacgccttttcctgcaacaaccccagcacccttccccgtggatcccagcccatgagtcctcgaactacaatggggcggaggaggcagcgaagaagggaacacaagagctcgttgtcgctagcctccagcacggtggggccgggcgggcagattgtgcacacggagaccacggaggtcgtgctctgtggagaccccctcagcggctttggcctccagctccagggcggcatcttcgccaccgagaccctgtcctccccacccctcgtgtgcttcatcgagcctgacagnccggctgagaggtgtgggctgctgcaggtgggggaccgtgtcctgtccatcaatggcattgccaccgaggacgggactatggaggaagccaaccagctcctgcgggacgccgcnctggcccacaaggtcgtgctggaggtggagttcgatgtggcggagtccgtcatcccaagcagtggcaccttccacgtgaagctgcccaagaagcgcagcgtggagctgggcatcaccatcagctcggccagcaggaaacgaggggagcccttgatcatctccgacatcaagaaaggcagcgtggcacacaggacgggcaccctggagccaggcgacaagctactggccattgacaatatccgcctggacaactgccccatggaggacgccgtgcaaatcctgcggcagtgcgaggacctggtgaagctgaagatccggaaggacgaggacaactctgatgagctggagaccacaggtgccgtcagttacacagtggagctgaagcgctacgggggtcccctgggcatcaccatttcgggcacggaggaaccttttgaccccattgtcatctcaggcctcaccaagcgtggcctggctgagaggactggtgccatccacgtgggggaccgcattctggccatcaacaacgttagcctcaagggccggccgctgagcgaggccatccacctcctgcaggtggctggagagaccgtcacactgaagatcaagaagcaactagaccgtcccctcctaccccgcaagtcgggcagcctcagtgagaccagtgatgctgatgaggacccagcagatgccctgaaaggaggcctgccagcagcccgcttctcgccggctgtgcccagtgtggacagtgctgtggagtcttgggacagctcggccaccgagggtggctttgggggcccagggtcctatacaccacaggcagcagcccggggcacgaccccccaggagcggaggcctggctggctgaggggcagccccccacccaccgagccccggaggacgagctataccccaaccccagctgacgagagctttccagaggaggaggaggaggatgattgggagccgccaacgaggcatcctgtgtcaccgctctccaccccgtctcatctgcccctgttctaactggccaccgacagtcctggtcgcccctaactgcgtctttcccctattccgtgtcaccaaccactgccccggggccccagaactgccaccgaggacgcccgcctgcctgcccgcccacccaccctatggcccctcgagcccaacgctgggccctggggccccgaagactcctcaggccccagcccgcccacccgcctgccaggagttgacgctctctggttcctacgttacagcccagcccctggccctgcccgagaggagggcttctggcgcatgtttggagaagctctcgaagacctggagtcatgtggtcagtcagagctgctgagggaactggaggcatccatcatgacgggcaccgtgcagagggtggccctcgagggcaggcctggccaccggccttggcagaggggccgggaggtacgagcctctcctgcagaaatggaggagctgttgctgcctacacccttggagatgcacaaggtgaccctgcacaaggaccccatgcggcatgactttggtttcagcgtctcagatggcctcctggaaaaaggtgtctatgtccacactgtgcgccctgatgggccagcccaccgtggaggcctccagcccttcgacagggtcctgcaggtcaaccacgtccgtacacgggacttcgactgctgcctggcggtgccactcctggccgaggcgggtgatgtcttggagctgatcatcagccgcaagccgcacacggcacacagcagccgggccccccgatcgccaggccccagcagtccccggatgctctgaagtcagcatgtgggccgaactcctaaggggccacccaggcagatcctggctcccagacacgtagctgggctggagaagcggccacccactcattcatctgttggtctggcagactctgagcctgggatgatgcttggtctctgttccccaggtctgtggtgactggggtgccaggcagggaggtcctgccctagttggagtgacagctggggtctctcgccaagttgggtctccaagatgcccagaggagcctcccttaagaagggttggcacaggctgctcagccgagaggagagaggcctgggggctgtcccaggtctctgtggggcctccttggagaggtcgaagatgtagggagcacttcctcccagcaaagccatggagctggaatgagctgcaaggaggagtgagttctcggtcacaggaggtgagcaggcaggagctggataccccagcgcagtcatgcattggggtatgaggcattcccatgatgcgtgcacacgcgcttgggggttggcttcctgatggggagccacttcatctagagactcggccaccaggaaggatgctgcttcggatgggagcccagctccttcgcttctccagaataggggtttggggcttgctagtcctgagattctgagattcccagaatctggtccccacttatgagactcttaagttggggcgtctgggatcccaggaagtgctggccctttgattctgaaagtgggtgattctttgatttcagcatctcagtctgaagcttctgggacttgagactgtggttctgggcccattgggcaggctctatgggccttgggctctcagccctcctgcttcttctgtaggccgtgtggccactgacccatctgcacgtccgctcagcccaagcccctccatgtgggaggggtcattttggggcaaaagaccctggagcttccattcacctgccatccagtgaaaattgaaaagcgatggacgcaggacctgtgaggcggtagcgctcctctttacagccagatcagtggaggaagaggagaaagagggagggagatgggagagaaatgggccagagaaaaagatgggacactcttgcccagtggagggtgtccaaagtgcttattcaaagaagtctattcccacttgaaatctggaagcaccagcatcccttaaaatcattgtcctcagtgtccacaaatcagagaccctcttcattttgagaagggtgtgggcctcccctggtggtctagtgagtggtgcctgggatggagtgggcgggcaggtgtagccagggctggggatgtgctttgcctggcccagttctcacaggggtctcaggaaaacggggcacccactcccacctccatctgtctccaacctggggtccctggaggccagaaaagtgctcttccatttgagggaacagatgaggagtcaagaggtctgttcttttcaccctgggtctgttacctgtttgctgtgtgaccctgtctgggttggacccccagcccctctggacgatcacgggtggacagtctgagcagacacaggcctcctggtcagggccggaaccatctctgccgacccaccaaggcccccttggggacctgcccacgctgtctcctggaggcctgcctcccttacccctcccctccacttcgctgggctctgccccttggtgccctccctgagggccctgcatgcttgtgcctggggtgctcagcgcctctgctatcttggattcccgtgtactcagcccagagtgaaagggcactgtctacctgtcacagggcaccaagtgaaagccaagagccctcacttttgagggtgagggacagcacagcagaggtgtggcttctggatgcaagcagccatagctgtgtgaccttggacaggtggctcagcctctctggacctctgctaagcaacagggctggacaggacacactctcagggcctctcggcttgggaaaactgcattgactccaggactccaggcgagggaagatgcacccgactctaactaatacccccctccctcctcgggctgaggcctctgccattctcccaaaagtatgcaatcaggcccgcggtgggcctcccagccatgccggcctcctcatatgcaatatttcttctggcttctcatggggatggttcatccccgacttgaaatttcctgacacctttccccagtgagcgccctgcctgcctatgcattttgggaacagcccctgtgacatgtccccttccacctgccctctcccccaaagctgtatttttctctggctgagattagaacacattccttgtaaagtatttttctacatcgggttttcttagggctctcgggaagcacaaggggctgtattgcaaaggccgcttatggtctgtttggggccctcgtctaagtctttgtcccaccaggggttgcagtggcttgggggtaggtgccatggggatgattttttaaaataaaattatttaaatcc

SEQ ID NO: 375599 - DNA, 620 bp, Homo sapiens
tggatcccagcccatgagtcctcgaactacaatggggcggaggaggcagcgaagaagggaacacaagagctcgtgtaagctgtggtctcttccctcctccttgggctgcttgtatgtctgagagtgaggcttgccaaagggtgtatgtcagggcgaggggaggtattttgggcagagctccaggtgtatgcgtgggaatgttaaataacatgagtggaacaccaggctgtcatggatggttgggcaggttgtgcactgctcaagaggaccactgagaggtgccagttactttgtacacttttattcttgtatttttattatgaaaaattcctaggatttggtgataacgtccttgaggaaaggaagtcttttcagatgtgcatgaagttttcacattttttgccattcagtcctgattcattcatggataaagcctcagtgctgcgttactatatccttaccacctctctgccatttgttaatttcccctaagacaaagacatggcctgagactctagctgtccagaatgtaataatttccagtcttacttctctgcttatttattgttcaaaattgcccttttgaaataaagatatttacatgttaagaaaagtaaatc

SEQ ID NO: 375600 - DNA, 8032 bp, Homo sapiens
  misc_feature (1440)..(1440): n is a, c, g, or t
  misc_feature (1554)..(1554): n is a, c, g, or t
  misc_feature (6238)..(6238): n is a, c, g, or t
  misc_feature (6477)..(6477): n is a, c, g, or t
  misc_feature (6544)..(6545): n is a, c, g, or t
  misc_feature (6550)..(6550): n is a, c, g, or t
  misc_feature (6560)..(6560): n is a, c, g, or t
  misc_feature (6631)..(6631): n is a, c, g, or t
  misc_feature (6635)..(6635): n is a, c, g, or t
  misc_feature (6645)..(6645): n is a, c, g, or t
cgatgggccctactccaaaggaggcaaggacgcaggaggggccgacgtttccctggcgtgccgcagacagagcattccagaggagttccgagggatcactgtggtggagctgatcaagaaagaaggcagcacgctgggcctgactatctcaggtggcaccgacaaggatggaaagcccagggtctccaacctgagacctgggggacttgcagccaggagtgatctgctgaacattggtgactatattcggtctgtgaacgggatccacctgaccaggctccgccacgatgagatcatcaccctgctcaagaatgtgggcgagcgcgtggtgctggaggtggagtatgagctgcccccgcccgctcctgagaataaccccaggatcatttcaaagacagtggacgtctccctctacaaggagggcaatagctttggctttgtccttagaggaggtgcccatgaagatgggcacaagtcccgcccgcttgtcctgacctacgtgcggcccggtggccctgccgacagggagggctccctgaaggtgggcgacaggctgctcagcgtcgatggaatcccgctgcacggggccagccatgccaccgccctggccaccctgcggcagtgcagccacgaggcactctttcaggtggagtatgatgtggccacccctgacacggtggctaatgcttcgggacccttgatggtggaaatagtcaagacgccagggtctgccctggggatctcgctcaccaccacctccctccggaacaagtcagtcattaccatcgaccgcatcaagccagccagcgtggtggacaggagcggagccctgcaccctggagaccacatcctgtccatcgatggcaccagcatggaacactgctcgctgcttgaggccaccaagctcctggccagcatttcagagaaggtgcggctggagatcctgcctgtgccccagagtcagcggccactgaggcctcagaggcagtgaaagtgcagaggagtgagcagctgcaccgctgggacccctgcgtgccctcctgccacagcccccggcccggccactgcaggatgcccacctgggccacacctgctggccaggaccaaagccgatccttgtcttcaactcccttttcctcgccgaccttgaaccacgccttttcctgcaacaaccccagcacccttccccgtggatcccagcccatgagtcctcgaactacaatggggcggaggaggcagcgaagaagggaacacaagagctcgttgtcgctagcctccagcacggtggggccgggcgggcagattgtgcacacggagaccacggaggtcgtgctctgtggagaccccctcagcggctttggcctccagctccagggcggcatcttcgccaccgagaccctgtcctccccacccctcgtgtgcttcatcgagcctgacagnccggctgagaggtgtgggctgctgcaggtgggggaccgtgtcctgtccatcaatggcattgccaccgaggacgggactatggaggaagccaaccagctcctgcgggacgccgcnctggcccacaaggtcgtgctggaggtggagttcgatgtggcggagtccgtcatcccaagcagtggcaccttccacgtgaagctgcccaagaagcgcagcgtggagctgggcatcaccatcagctcggccagcaggaaacgaggggagcccttgatcatctccgacatcaagaaaggcagcgtggcacacaggacgggcaccctggagccaggcgacaagctactggccattgacaatatccgcctggacaactgccccatggaggacgccgtgcaaatcctgcggcagtgcgaggacctggtgaagctgaagatccggaaggacgaggacaactctgatgagctggagaccacaggtgccgtcagttacacagtggagctgaagcgctacgggggtcccctgggcatcaccatttcgggcacggaggaaccttttgaccccattgtcatctcaggcctcaccaagcgtggcctggctgagaggactggtgccatccacgtgggggaccgcattctggccatcaacaacgttagcctcaagggccggccgctgagcgaggccatccacctcctgcaggtggctggagagaccgtcacactgaagatcaagaagcaactagaccgtcccctcctaccccgcaagtcgggcagcctcagtgagaccagtgatgctgatgaggacccagcagatgccctgaaaggaggcctgccagcagcccgcttctcgccggctgtgcccagtgtggacagtgctgtggagtcttgggacagctcggccaccgagggtggctttgggggcccagggtcctatacaccacaggcagcagcccggggcacgaccccccaggagcggaggcctggctggctgaggggcagccccccacccaccgagccccggaggacgagctataccccaaccccagctgacgagagctttccagaggaggaggaggaggatgattgggagccgccaacgagcccagcccctggccctgcccgagaggagggcttctggcgcatgtttggagaagctctcgaagacctggagtcatgtggtcagtcagagctgctgagggaactggaggcatccatcatgacgggcaccgtgcagagggtggccctcgagggcaggcctggccaccggccttggcagaggggccgggaggtacgagcctctcctgcagaaatggaggagctgttgctgcctacacccttggagatgcacaaggtgaccctgcacaaggaccccatgcggcatgactttggtttcagcgtctcagatggcctcctggaaaaaggtgtctatgtccacactgtgcgccctgatgggccagcccaccgtggaggcctccagcccttcgacagggtcctgcaggtcaaccacgtccgtacacgggacttcgactgctgcctggcggtgccactcctggccgaggcgggtgatgtcttggagctgatcatcagccgcaagccgcacacggcacacagcagccgggccccccgatcgccaggccccagcagtccccggatgctctgaagtcagcatgtgggccgaactcctaaggggccacccaggcagatcctggctcccagacacgtagctgggctggagaagcggccacccactcattcatctgttggtctggcagactctgagcctgggatgatgcttggtctctgttccccaggtctgtggtgactggggtgccaggcagggaggtcctgccctagttggagtgacagctggggtctctcgccaagttgggtctccaagatgcccagaggagcctcccttaagaagggttggcacaggctgctcagccgagaggagagaggcctgggggctgtcccaggtctctgtggggcctccttggagaggtcgaagatgtagggagcacttcctcccagcaaagccatggagctggaatgagctgcaaggaggagtgagttctcggtcacaggaggtgagcaggcaggagctggataccccagcgcagtcatgcattggggtatgaggcattcccatgatgcgtgcacacgcgcttgggggttggcttcctgatggggagccacttcatctagagactcggccaccaggaaggatgctgcttcggatgggagcccagctccttcgcttctccagaataggggtttggggcttgctagtcctgagattctgagattcccagaatctggtccccacttatgagactcttaagttggggcgtctgggatcccaggaagtgctggccctttgattctgaaagtgggtgattctttgatttcagcatctcagtctgaagcttctgggacttgagactgtggttctgggcccattgggcaggctctatgggccttgggctctcagccctcctgcttcttctgtaggccgtgtggccactgacccatctgcacgtccgctcagcccaagcccctccatgtgggaggggtcattttggggcaaaagaccctggagcttccattcacctgccatccagtgaaaattgaaaagcgatggacgcaggacctgtgaggcggtagcgctcctctttacagccagatcagtggaggaagaggagaaagagggagggagatgggagagaaatgggccagagaaaaagatgggacactcttgcccagtggagggtgtccaaagtgcttattcaaagaagtctattcccacttgaaatctggaagcaccagcatcccttaaaatcattgtcctcagtgtccacaaatcagagaccctcttcattttgagaagggtgtgggcctcccctggtggtctagtgagtggtgcctgggatggagtgggcgggcaggtgtagccagggctggggatgtgctttgcctggcccagttctcacaggggtctcaggaaaacggggcacccactcccacctccatctgtctccaacctggggtccctggaggccagaaaagtgctcttccatttgagggaacagatgaggagtcaagaggtctgttcttttcaccctgggtctgttacctgtttgctgtgtgaccctgtctgggttggacccccagcccctctggacgatcacgggtggacagtctgagcagacacaggcctcctggtcagggccggaaccatctctgccgacccaccaaggcccccttggggacctgcccacgctgtctcctggaggcctgcctcccttacccctcccctccacttcgctgggctctgccccttggtgccctccctgagggccctgcatgcttgtgcctggggtgctcagcgcctctgctatcttggattcccgtgtactcagcccagagtgaaagggcactgtctacctgtcacagggcaccaagtgaaagccaagagccctcacttttgagggtgagggacagcacagcagaggtgtggcttctggatgcaagcagccatagctgtgtgaccttggacaggtggctcagcctctctggacctctgctaagcaacagggctggacaggacacactctcagggcctctcggcttgggaaaactgcattgactccaggactccaggcgagggaagatgcacccgactctaactaatacccccctccctcctcgggctgaggcctctgccattctcccaaaagtatgcaatcaggcccgcggtgggcctcccagccatgccggcctcctcatatgcaatatttcttctggcttctcatggggatggttcatccccgacttgaaatttcctgacacctttccccagtgagcgccctgcctgcctatgcattttgggaacagcccctgtgacatgtccccttccacctgccctctcccccaaagctgtatttttctctggctgagattagaacacattccttgtaaagtatttttctacatcgggttttcttagggctctcgggaagcacaaggggctgtattgcaaaggccgcttatggtctgtttggggccctcgtctaagtctttgtcccaccaggggttgcagtggcttgggggtaggtgccatggggatgattttttaaaataaaattatttaaatccacctagagtagaagtttgctttttaaaaaaatcatggattggcaagagtcagcttctgtatgggtctggtgacatctcacctgcttttgatgattcattaattcaaaaagtttgccatttgcttccatcatccagcccctgggcaacatgaatcagacagatttaggtcatgtctgcacattctggtggcaggcagacaatcaacaagtaagcaaataaataattatttcaaaaggcatcaagtgcaacaaagaaaacaagggagtaacgggatagagggaccagggtgaggggctttagctcacaatattaggaggggtttctctcaagaggcgacatttgcaatgagacctgaagacaggagccagcctccatggagacctggaggaagagtgtctcaggcagcgggcacagctagtgcaaaggccctgagataggaacgagtttgacggtctcaaggaagagaaagaaggcctgggaggggaatggggctggagactaggttggaggtagcaggaatcagtcgtgaaggcttgggtagggggagcaaatttgattctctgcgcagcagaaagccagaggcaggcagtggtgcctgcatatggagtctctttagcccaggttgggaaggtagtggcaggagggcagcctcnggtctggctgctgccctggagtgtccagagagtgtctagggcaggtgagctacagggtctgggacccagaggccagggccaggccccactggggaggccacagttctgtgagcagaggaagagcttctttccaggaagcgagtactctgtcttgggagtggtgtaggcagggggaaggccaagggaggcagcaggccttgctctaagcgctttgcaagagcttgctggatcctcccaanagcctttggaggtgggctctattcctgtcccatcattacagatgaggaaacaggcacagagaggttnngtaanttgcccaagnccacacaggtagtaagggatggaaccagggcttgaacacaagccacatggccagtacacatagagagaggnaggnaggtaggcanaggctgtcagaaagagccagaaaatgggggtagggtggtcttctattctaacattgtctataaatgagttactgagaattttgtctggttagttgggcaaagggctcaactgactcccgagtttgtccatcccaaagggtggggggcgctgttggcaggaaggctgccccaaacatggacctgttgtgaccccagagagcccctaactgggtattaatgagcgcctgcacctgacggtgggggagtgggagaagggcaatcaggtttgctccccctctaccctttcccccactccgccacccgctttctgcccttctggcaggtcagcccaaggctaaagaggagggactgaaagccgcagcaggtgagcacctaaggccaagagcatcacctccaatcatcctggtggccttgatggggacaatggtttattccagatggggaaactgaggctcaggtgactgctgccagatctcccagctgtacagggctgggcatgtagcaggtagaatcagtagagccagtagagccaagagctcatgggcccgggtgcgaatccaggttctttcatggacttgctgtgtacccctgagtgagcaagctgcttcctctgtgagcctccatgtgggaacctctaacctgggaaaatacctacctttgaggagcgtcctgggattggacgggaagccctttataaaatgtaaagcgtttggcaaacgttgagggggaaatacctcaccagaacacaacccacacatgttggatgttaaaaaggaaatgtttattttcatgttataaggtgattacaaactcctctaaaaaaagcaaagatgaatttaaaatattgatatacatatttatctaaaaagcaaaagagaaaaaaacccctgcaaaatacagggaatcatatcataaaacatttatacacaaaagcttgtatactgcaagactgaactacacaccaaggatcttgttcaaatacaaatgttcctcctcagaaaagtctcttgttggttgattttttttttataaaagtttaaaatatcttaaaaatattttgaagttttaaaaaaatgtcctgatgagccagacatatttctggaaggaggcaagacccacattctcagctttctcttgtgctaaatacagaagtcatgagctctcatggaaagtttcgtttatacggagacatgaaggttgagcattattacacaggtactcgcagagctatgctctgcacacagagccagggctggctgggcgagagggctctgattggagacaggtgccttggggagagttgaggaacgacttccttccaggcggggcctggggacttggtctgcctgtgtctttggtctagaatttggtctgagaatcttataag

SEQ ID NO: 375601 - DNA, 667 bp, Homo sapiens
aactctccctgtactgtgcctaagcctagcacttgtgatgcctccatgccccgaggccctggttagacactcaccattccctgcacctacctcggagaacctgcagctagagctgtttcaagaaaatccattcctggctcacagtgcctccctgagcctcagttacctcatttacaacaagggcgttgggttaggggaccctggaggcccttctctccctgaccgtcaggaaatctctgtggccctagcatggcccatctcaacgcagtgtctcccacttcttcatcttaaaaaattgatttaaacaaccccctcgcttcctttccagatctggctggctgggctatgtgcgggcatcagcatttctgacccatcccaagcagaaagcaggtgaaggactttgcccattctctatagacaggtggaccagagtcatgagctctcatggaaagtttcgtttatacggagacatgaaggttgagcattattacacaggtactcgcagagctatgctctgcacacagagccagggctggctgggcgagagggctctgattggagacaggtgccttggggagagttgaggaacgacttccttccaggcggggcctggggacttggtctgcctgtgtctttggtctagaatttggtctgagaatcttataag

SEQ ID NO: 375602 - DNA, 1148 bp, Homo sapiens
ggaaatgaaacaaactccagagaaacattcttgggaagaataaatgattgctataaacgatcattggaaagaaagcttccaccaagttgcatgataggtgggataaaggaaactcagggcaagcatgttattctgagtgggagcacagaagtgattagtaatgaagggggccggttctgttacccagagttttccagtggcgaggagagtgaagaggatgtacttttcagtaacatggaggaggagcacgagagttgggatgagagtgatgaagagctgttggccatggagattcgcatgagagggcaacctcgctttgccaacttcagagcaaacacattgtctcctgttcgattctttgtggacaaaaaatggaataccatccccctgcgaaacaagtctctgcagagaatctgtgctgtggactatgatgacagctatgatgaaatcctgaatggttatgaggaaaattctgtggtctcttatggacaaggaagcattcagagcatggtgtcatctgactccacatcaccagattcttctttaacagaagaatcacgttctgagacagccagtagtttatcccagaagatttgtaatgggggattatctcctggtaacccaggagattctaaggacatgaaggaaattgagcccaattatgaaagtccctctagtaataatcaggataaagattcatcacaggcttccaaaagctcaataaaagttccagagacccacaaagcagtccttgctctccgattagaagagaaagatggcaagattgctgtacaaactgagaaggaagaaagtaaagcctctacagatgttgctgggcaagcagtaaccataaaccttgtccccacagaagagcaagcaaaaccttaccgagttgtgaacctggaacagccattgtgcaagccatatactgtcgtggatgtgtcagcagccatggccagtgagcacctcgagggccctgttaacagccccaagacaaaaagctcatcctctactccaaactctccagttacatcatcttcattgacaccaggacaaataagtgcccatttccaaaaatccagtgcaattcgataccaagaagtatggacttctagcaccagtccgacgacttaagtatcaggtagaac

SEQ ID NO: 375603 - DNA, 370 bp, Homo sapiens
catgtaagtgatggagaggtttccttttcaataaaatattgaatttccatttactcagactcctttggtttcaattaatagctttttaatttttttcttattatggttcttatgttttatttgttttgagatattttatctttttgttttgattacatgtggaatattttactaatatatcctataggtattattattttcttaaaagcaagctactgaattcagcatattcattatatacagtaatttttcagttcattctcttggattttctacttatacaattctaactgctgtaaatagtgacaattgttcctcctccttaatttttttgtacatccaatttctttcattttctaactgactgcta

SEQ ID NO: 375604 - DNA, 580 bp, Homo sapiens
ccaaacccaagtactgtgtccaggaagatggttacaaaggagtttctaactcatcatatactcttcccaaaccagccttcctctccatcttgagcctgtccttaagatgtcctgtctgtcttgagcctgtccacactctgcctgccctaatgataacatcactcccctttggggactcccttatcattcatgcagagtggttcacttccttccaagtattcagctctgcataccacaggggactctccaggctagccatggtgaggtttctaaggtttttagtacacctttctttgtaactacggaggtatcattcaagtggcttcccagaagaaatgtgatctgcatccaggtgacctcaatagattcctagttgtaggaggggctgccatgatttttaagaactcctccgatgggtgttttgcttactctgcaaaagacacataatacacaacatccaaatgaatattggccttgggctgggcacatggctcatgcctgtaattccagcactttgggaggctgaggcgagaggatcccttgacgctgggagttcgagaccaggctgggcaacatagca

SEQ ID NO: 375605 - DNA, 517 bp, Homo sapiens
gaacaatgatactatttaccatggcaagtggtaggaaaactgttgtccttggacataattgttttttaggagttgcttttgatacccatatcaatttataattctttgtttgaaatgaagtctttacatggttcattgaagagatagattggttatttcatactgataagcattctactcttatttgttatgcattttccttagtgatatattttacttgtactgaacttgaaaatataaaggagaatacatttctaaattattttaaatggctaacactatgatttgtcttatttaaatagatgtctctgcaccggtaagattaatacaatatgtgaatgtctattttttatatcttaactcacaatgagtatatgaaagataatacacgaatatattacattattcatttttagtcatgagtttatttcaataagtttttctaattgtagatactgttttttattctttccttgtatctaaatataaatcaaccattaaaatcattctaactcta

SEQ ID NO: 375606 - DNA, 216 bp, Homo sapiens
tcccacttctgggtatttgcaaatcactttattaggtttttaaaagtattgttgcaggcatgcgaaggggccgatatacttttgccatgtccagagtgtattcaggtcttgtaatgatcatatgggtgtaatattgagtaacaggcaaatgtgggcagaaaatatcaaatgtggttttcagctaagaagtctggttgctcttaattttcagttact

SEQ ID NO: 375607 - DNA, 453 bp, Homo sapiens
catttatagaaagtaagcaaaagttaacatctctcatcaaatcattcattacaatttcagaactgtaaacagtttggtagtggaataagtgaatattattggacattcttaaagtgaatatggcaaatctgtctacctcagtggatacaccggtctcagaagacacctgactggttaaaaatgtctgacccatccccgcaagcccttttttttttttttaaatgtttcccgatcttgtggtagtcttatggtaaatctaagctcctaaaggattttaaaggagcttagcaattaggaactgcttacagttaaatgggattttttaatggggcacactaactaggagtgtaatgtgtatattatttgtgatcatagccttagttcttttttctgctattaccctggcatatctttcaaagtcacaggtgtgtgtcctgccatctcattagtgaa

SEQ ID NO: 375608 - DNA, 1895 bp, Homo sapiens
agcggtgtaaaatacttgaaaaaaattaaaacttcaaaagggacgaatttctctgttaacttttgtttatcctatactgacttattttgaaatgtgaaaaaacaggcagctaccatataaattggtatctatgaaaatactgattactttcttcctgtgattttcactgttaagaaaactttgtcttgaaatgatggacaatcttaatacttgttcagataaagaaatgtgactttcaatacctttaccatttgtatttctttagggaaatattttaataatgattgtaaaaataaaagaaatatggttgagaaaaatagaagaaattaagatgaaatttgaacagttgtaatccacagtcccatttttccctctattttattgccttctactaagttattgaaggcccagatctgcaaaatttacaagctactaattcattgtctcctttaagaatttggagcaaaaattattccgactatgcggaaatgaattcacatcatcatggcaggttttgactatgagggaattcaggttaggttcaaatagaataatggtccatggagaaaaatactttctgatttttcttcaagttggatggaaaggtttttctttatttaaaaaaaaaaaaaaaagtcctcctggagaattttgccttcgaaaaagaagttttataacagctggcctgtagctacattataacttcggtaattaagtgacaaaactgtctcattatgcttttaaaatactgaattaagtgcattccagaaataatacatatcattcatttcaaaatcaacctacctgaattctgactcttcaatcatgagtagccattttacaaaaccaaagggtctcatttcccaaacagtactttaaatatcatcctaatagtaatatcctaatagtaataatcctattaatactcacttcaatgcataaaataaacagccaatgcacttccatcaagtctgcaggcactatataataataaataggtttccaaaatcacttaataaaaacacacagttataatgtgctcggccttcattagcatcctctgcatggggtggttttcatttaacctgaattattttaacattttggctaatttgtttgctgcaatttcatgggtctaaatttttggtttggtttgcaatgtaaatcatattgtatatctgctcctttgttattagatttactttgtgaataatatcttttaaaaattgagttatcaaaaacttaaattataatgtcatcaactaataccaggtaaatatactaatatatatgtagggcatgattaaattgcatatattttgaaatgtcaaactattttttgtttttttaaaaaaatgaatgcatctcttaaacctgtaccattaattttaaaaaagtttcatttggtatttcatattatattttaaaatatttttctttatctagtagtacaggtttaaagaaactttttctgattgaaatgataaaatatgcctcatttcactagaattttaagaataatacatgtaaaagtataactcatataagattataaatatccacaatatcttctttgattttcatgtaacaccactttttactcattcttttatttgttattattcgaaatcattcacaatgtaaatagcatgtttcatgatgtaaaatgtctttgcatttacagactgcagaacaaggtgaatttgtatatgaaaaataagtgatggaaacgtgggattcttataaaacaaagtggaaatgatagttctgtgttatatttacataattcattacaaaattgtctagttaagtcatgcatttatttaccttaaaagtgtccaaactgtcacttataaaatatttaaatcaataaataataccaaaaaggaaaagaa

SEQ ID NO: 375609 - DNA, 732 bp, Homo sapiens
gatactgttcttatattctcttcatgtctagattgtagaaattattaaaaatagctatttagggctatactgagggagcggaaatattcttggttaaagtctgtttatcggcaagagcatttggggatgaaggaaataattccttcctatgaatttgctaggtttctggggattggattcaaagagcagaagtatgatgccaggggctggtaaggactcagccatatagagatttcagctgcattataatgtatatttgagaaattgagttcttattatcagaaaattgacctatgtaatgaaatactagaagaaaactctaaattagaatggctttgttatgaatttttaatgataagtactaacacttaaaagggaaaaaatttttcaaagaaaatgcctaaaaatgtgttgtatctgagatcatcatatatgtagtattacagtgcaaacactattaatgttaatgaggtaggtggatttttttaatgaaaaaacttgaaatattatcaggttgtccccatttatggaatttaagcttgtcagaaagatccagatagctatattaatattttatctgtatttggttgcggttgcttttaaaaataagttttcttataagtcatttcaattttttggtttagagtccatatttcaaaataaaaagttaaaaaaagagtaccttatgtaatttagcaaggtattccataaactcagggaggaaaaaaaaaa

SEQ ID NO: 375610 - DNA, 1099 bp, Homo sapiens
agattaagttatgaaatttatttatattttaccttttaaaagccagaacataacaaatctcactttctggaaagtcatcttattagaaatacaagaagtgcacttaatacaaggaagtaagtttctcggtgccaccagtgaggtggacatacactcacatcagtccctcaaacgaaggtttcgccagatttccctccagacttctgagatgatctgaattcaggaaggtctgagtgaacttcttccagaaattacagtgaacaagctgaccttaacttttgggtcctcccgagaaatcggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcggc

SEQ ID NO: 375611 - DNA, 297 bp, Homo sapiens
aagggaatccgtgctggtgctaagggaattcgtgctggtgcttcgtgctggtgctaagggaattcgtgctggtgcttcgtgctggtgctaagggaattgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcggc

SEQ ID NO: 375612 - DNA, 467 bp, Homo sapiens
ccacctcatcctctccttctttggccctgccgctcccatccattctctgggttgtggatcattctctgacacacgggcctcagaggctgcattgtgaagctccaggtctcggggctggggaagagccaaggggcatgaatttgtacttatccggaatactcaggacacacaggcatcccggcctccctcctgtgccacctgcctgaagttgagctgatgccttcaagatctgtttccccaaggcccttctgctgttaggtagccagtgagctgtcctcaggtgcaccctctcctggcccatccccacggggttccctcacaacattccactcccctccctgtactgaccccgggctctgcacagccctggagtccagggccctgaacctggactagcagtcctcacaggtggtggcagggtcacagctagccaaaccaaacacagccggtcattgccagttgctgct

SEQ ID NO: 375613 - DNA, 305 bp, Homo sapiens
aatgtctctgtcatatcactctacacaactggaatcatgtttgtttgcatctctgttatctgtctcctgcctgccttgaatccataaggacaggaaccttgtctgtgttatctctgctgtatccctggtgcctggaatggggttggtgcggagccagcactccatatgttgttgtggaatgaatgatggcacctgggtgctatcctcccagaccctgagcaagtcagctctctaccgccatcgaggccttctgctgctgtcccccactccccagtcacttggcccccaacccatccctggccacc

SEQ ID NO: 375614 - DNA, 449 bp, Homo sapiens
tgacttcacatatctttttcagcgcttatacaaaacggcactatagaacctccattttacagcaccatatgaagtgggaaaattaggtgaaaattttcctgaagcaaccttaacatgcgcagcccttgttggtttgtgacttgtggcctagctcatcagatgagccacgagaatcagacctggattttgatctggccctgttctgacatgcaatgaggcatttgtaggatttagtaatattgctagttcaaagaatactagaaatattagtaagaacctattcaaaagtattcatgagtattttctgcatatgaatcaggaattagaatattttgaaaatgatgttaataaaattttcctctggaaggcctttataatttttattcccaatcatttttcaaatttagaaagtttaatctgtcacaggagaaaaaaaattaaaaattttc

SEQ ID NO: 375615 - DNA, 149 bp, Homo sapiens
ctgatcacaactcatctcacctgttgctgctgaggacatccagacttagtggtgcctggtgtgtactcagaaagggtaattgcccacatttgactgcatattcacaatctgtgaatgaaaaaaaagccaaaagaaaagttggggaatct

SEQ ID NO: 375616 - DNA, 674 bp, Homo sapiens
cggtaattattgagctatttttatagttgattcaagaattagggtggctgatagactttaaacaatattttttcgtttctataaaatgtaacttaaataacaactcttgatttgaaaccataaaatgggatgtagatatttgggggacagaagaaggattgaacaaccagtttatttctctgttgcctgttgccttgtagcttgtcgtcattgttacagccatatttgactctgtgtagaagacattgttgatgccctattgcaaatccacccttctttgcttccttgcccacagaaccatgaattgtttacatatttacccatcagggaagaggactttatcaccacaaagggctatatcttaaatagtcttagcaggtgggataatccctctttccttatccataagtggaggagaggtgaaagtgtcacccaagtctggccagtatgcagggcagtttgcagggggatgtctgcaagaagtttcttccttcacaaataaatatatgaggagttgcgtttcttttcttttcttttttttttttgagactgtgtcttgctctgtctcctatgccagagtgcagtggcatgatcatggctctttgcggtctcaacctccttggctccagtgatccccccacctcagcctctcaagtagctaggccctcaccacc

SEQ ID NO: 375617 - DNA, 377 bp, Homo sapiens
caatccattttgaaggtggtgaatgtaaggctcagagaggttaattgattttcccatgatcacacagcaattgagcagccagtgcagcactcaaaacgggtttctcactgctaggtcccttctcttccactactgtgtctttctcccagtgtctctgtttatacttaggtatcattgtatttatttttcccccagctttatattttgaactcttattatacaaattttcaaacatacagaaaagctaagactagtacagggaacacacttaggtctttatctacattcaccaattgttaacatttgccatatttagctgtataatgtgtgttttgttttggaatgatatggaagttggaggcatctcaatctttcat

SEQ ID NO: 375618 - DNA, 815 bp, Homo sapiens
tgtcgcccaggctgaagtgtagagtgcagtggcatgatctcagctcattgcaacttccacctcctgggttgaagcaattcttctgcctcagcctccggagtagctgggaatacaggtgcaggctgccacgcccggctcatttttgtgttttagtagagatagggtttcaccatgttgcccaggctggtctcaactcctgagctcaggcaatcctcccgccttagcctcccaaagtggtaggattacaggcgtgagccactgcacctggccctcgactcacagattttcaaaatacttttgaacagtaagctgaggacagtgtttattatgactatactggtctcctttcactagctcacaaaatttaactacatcacttgtcagtctcctaaaaatgcagtgtatgtgctttgaaacttgtgaatgatctgctgatttgtgctattttatattcaatgttgttgaaagaatagtttttaaaccaagtaatgcaaaaatttagtgtaacatgaatgcttgtgctgtaaaacatactggaaaatcaatagctctggaataaactttggatttttaattaaaattgattttgatgtacttatgctgttaaattggtagagactagtctgaaaagctgagaaaagataaagcagaattaaaacaaaatctatcttattcgtagagccatgtcaagaatgcattctctctacacctattccaatgggcacattagtacttgattatgcagggagtgaatcatgccaagtcttcacgtacacattgctcctatcactgctgtgcagtgagccgtgactgcg

SEQ ID NO: 375619 - DNA, 577 bp, Homo sapiens
aaaggtcctgccatcagtgagtgtatgtcctggtagcctttaatacacttcatgtttatattatgaaacagtttatagtaagataatatatgaagtatacatgtattaatatatgttatatattttatatgctttaggtttaagttaaagtttttataaaatgttcctcagcttaatgtaactataagtaaaaatgtaaatggttttatgtgggatatgtttgtttctacgtctgtgaatttaatagtaggcctcaaatgattgaaaataagagtaaaatcatacgtgagatttatatcaacatcagactaaaactcattattactaagtgtgatttttctcatatttttctttaagcaaagttactttacttaagtaactttaattctttcctcaatctataaaactcttaattcaaatggggagtttattgtagaaaaaagtatttgtaagtcacattgagtataattggcacattatagacagatactgaaatcaaaaggttgtttggcctattttaatattaagtgcatattgtaattcattttatatctagtagttataatttaatagtttt

SEQ ID NO: 375620 - DNA, 428 bp, Homo sapiens
cccatgtactctgccaactaaattgatttctacagctgggagtagtggacctatcaaaaagtttctaatctctcctgaatttagataaacctgtgcattatatctttttttaaaaagttcaatttaaaagaatttgatcttaagatcttaaagtagaaaattaaacaatttttatttttctgacgaggtcacaaaagatcatcctgtgaacaaagcaaatgtatacctgaactactttcagaaagaagaatatttctattttacttctaaacttcagagacatttagtaagaaaggccatgagctctcctgaataagaagttccaccctcaccaggaggacctagcaattataaatacatacatctgacatcagagcacccaaatatataaagcaaaaaaaaaatttttttcaaactccaccaaaaaa

SEQ ID NO: 375621 - DNA, 478 bp, Homo sapiens
ctttgcatctcatctccaagtggagctgacctggatagtcatcccctggttcctaggtctggccatcggatcctagaacttgcaactgagaagggggagacctggcttccatgtagaggacacacgatttcctcccctctgagggggctcgtgagggtgactgtcgggcctctcctggagcctcagagaaggactcacttgtctgtgggtgaatttggaaggagaacctgggcatacagagcccagccctttggctcactcttcctcttgggagctgacccgcccactgctctatctcttccagccatgcatgttgtggggcctggtcccctgtggatggcccatggtggcctagagctgtctctgccagggggcatatttgtctaattccatcatgcagttttaggcagtccatttgcctgtagatcgaggccatgccctccaacggtggctttatcagcagtaaaacttgcaggtt

SEQ ID NO: 375622 - DNA, 405 bp, Homo sapiens
aaaaaggttaaatacttgcttaaagtcaagttcatgaagcagaactaaaattcaaacctaagttcactaggctccaagcatataccatcaaatgccctaataaattccattttaaaatacatttagtcctgtccaattcttgtaatcaagagcctcaattctttagttgtgtcaaacattctttttaatgccaacttaactacagtaataactactatgcacacagaaaatatcagctggacttttgaggttttattgctaccacactggccttgaacatatgtggaaagacatagataatacaaaacttcagattccataaccttgtaatattaaaacgttttcatgcttctgaaaatttaaggttttgagaatggagtaaagtaagaagatgataagcaacta

SEQ ID NO: 375623 - DNA, 435 bp, Homo sapiens
tcatggcagaaatattaagctcacttatcagagttataaaggcttttaaaatatatatatttcatggcatttcaagcaattgatcacaccagttgggggaagacaagagggtgaccacttgtatgcagaaaaaaaaatactggcaagaaaatgtggcaagtgcttccagtaaagacgcttctttggaattaaatggtgatggatgtttagaaaccagtctcaatgcaaaactgtaatttttgcaaatggttgtgtcttgggatggcattaacatactcagtgttctctatagaaacgaggacatgctattaaaaaagcatccagttcctgcacacaaactgaagtttgatcttaagcgggatgagatattactgcaaattggtttttacttcaaaaacggtttaataacaatcacgcccagagctcaagtgcaca

SEQ ID NO: 375624 - DNA, 332 bp, Homo sapiens
gtcgacggataatactaacagcaataatagtagtcacagtattgtcattgggccagtttctgacccaggagtttcatcttttagcagtattcatgaaattttggcatgcaaacttgttagtgttgaaactcagaaaacaataccccaaaatggcctcaaaagcagaaatttttctctgccctcctatctctcagtcccccaaggatagccatagaaattagaattccttttccccaaggcaggtcatagaaaccagaacccctttttcctaaagccagtcttgaaaccttaaaatattactctttctctctgcctttctgtggaataactgg

SEQ ID NO: 375625 - DNA, 528 bp, Homo sapiens
cctatgtttgaaattaaagctataattgaagataatccgtacaaaatgactaataatttggaaggttttttaaatttttgagcactctaattttgttaaaactgtgaaacaccatagttattgctgtctagagaattgtcatgagcttatctaaatgtttataattgcagtattaaagcactgccattaaaacaaagcctattatatatccccagattaaaagttattctacctcgtgttgagggattttttaaactattgacattttcttttttgctcaaaaacatgctttcaaaatctgccattattttgttaatgattttgagtctgaaaccatttaatattgtgtttattaatgttggtgttctttcactttgctgttaggtcaaaattatgaatgtgcatatagcaacttccagcaggaagggtgggtaaaggttttaatacgtacagtttgttccaactaccatcttattatgctgtattcaaacttgaaaaaaaaaaagatattttaagatggtaggatgg

SEQ ID NO: 375626 - DNA, 362 bp, Homo sapiens
gggctgtttatttagattcaggcctagtgtcaaggtcaaggagacatgaccacagaggcgtgagtggaggaagaggggtttgcagcacatggctccatccccagaggatctgggtggaaacaggaattcattagcttggagtgttcatcatctgggagaaaaacagaggccaaaagccattgggagaaagagtgattcttatttgggatattgccacacctggggagtcaaggcatgagtgagatgaaagctctagtcctggctgggtgtggtggtttatgcctgaaatcccagtgctttaggaagccaaagtgggccaggagttcaggaccagcctgggcaacatagcaagacactatctc

SEQ ID NO: 375627 - DNA, 919 bp, Homo sapiens
aaattagtgatttagtaaatttgcttactggaataaaaaagaaagaattgcaccattatgaataatgtgtcaaattctatgaggttctaaatgtgtggatcttgttgctctgctatttttttccagcagtcgacttcaatcgacatccccctaggtttctgactcaattacatatagatataactttagggatataatacatttttattaaaagataaaatctgtcataatgtctaatttttgtatttttaatggagacagggtttcaccatgttggccagaatgatgtcgatctcctgaactcgtgatccgcccgcctcagcctcccaaagtagcctacattgcctctactttgaagggacaaagttgtcctggtttttttttcccttttattatttcattataactatcctaaaacttacatacattgcctatgtttggcattccataacataataattataataatcccccaatgtcagaaatgtatgtgtgagttcccatgtttattggcaatttataagctttttaatattgtactattttaaactaaaatgtagaaagaatattatgtttatatacagtcagataaattattaactgttgtaatttaagctgaaaatgaaactattttagtatcagtatagaagaaaagtatagtttctaatcatctataattttaaaatgcaaagcctataaaactttcaagatgttttgcctgtttgtttttaagatttataataattttctatctttagcaagtagctatttttaagccaggtaacttctttatttgaactgtattatactctcagaccctcatcctgcctagaaatgaataagtaataaataattactctgtattatttacttcttttattttatagtaaaatattcatttggatggacattaatttga

SEQ ID NO: 375628 - DNA, 1145 bp, Homo sapiens
ctacccaacctacgactctctaagcgacctgaaccgccgggtgcccggccgttgcgcgggctgatgacgtacggaagctgccggcgttgccctctcccaagatggcggccaggtcgcctgctcgggcctcccaggcgactttgccccactgcgcccgcgctctcttctcctttccatttctggaccaaggggctgccataaggagtctgtgactagagatgggaggtggtggccacggcctctcgctgtatgctgtgtggaaggtcgaatcatcatcatcataaaacttaatattgcccttatgtgccaggaactactatctcagcaatggagatgtggtgcttggccgcaatcgtgaatcggccctggaggggacacaggaaggggctgcctgcgactcatgacctcctgcgtgcctgcctgctgacctatgacccttcaagttcccacccctcagccacgcctgtgaggagggtcttgttttgtcgcctacgctggagtgcagtggtgtgatcacagctcactgcagcctcaacttcctggactcaagcgattttcctgcctcaacctcccaagaactaggaccccagatccccatggacaaggcacttgcatgaattgtgaggctcatggagttggggtcggacaacacagagccggctccctccaggagctgcatgtccagagagggaaacaggatgtggacagcaagaatgaatacatgcagaccagtgcccatgggcggagggcagaagagaccgcgcctgaagcctcatccatcctgtgctcatctgcacacggtcagcttctgtgggtcccaagccattctgcccacacatctcctaactgacgtttgggaggcagcagcatctctcctcctcctcgtgcagctgaccacctccagctcagctctgaggcttctccccttcattctcctccagctgaatctgagtcagagtttctaagctggaagaggaccaggaggcctggccctatcctcttaagttttgagcagcagaaaagacaaagccttccgggttttcactatatgatttcattattttcaagagttccaaatttgagtataaaattacggccaggcgcggtggctcatgcctgtaatcccagcactttgggaggccgag

SEQ ID NO: 375629 - DNA, 1068 bp, Homo sapiens
ctacccaacctacgactctctaagcgacctgaaccgccgggtgcccggccgttgcgcgggctgatgacgtacggaagctgccggcgttgccctctcccaagatggcggccaggtcgcctgctcgggcctcccaggcgactttgccccactgcgcccgcgctctcttctcctttccatttctggaccaaggggctgccataaggagtctgtgactagagatgggaggtggtggccacggcctctcgctgtatgctgtgtggaaggtcgaatcatcatcatcataaaacttaatattgcccttatgtgccaggaactactatctcagcaatggagatgtggtgcttggccgcaatcgtgaatcggccctggaggggacacaggaaggggctgcctgcgactcatgacctcctgcgtgcctgcctgctgacctatgacccttcaagttcccacccctcagccacgcctgtgaggaggtatgaagaagacctgaggtgtgaagaagatcgagagggtcttgttttgtcgcctacgctggagtgcagtggtgtgatcacagctcactgcagcctcaacttcctggactcaagcgattttcctgcctcaacctcccaagaactaggaccccaggtgcatgccactacaccaggctaatttgttgtagagaggaggtcttgctatgttgcccaggctggtctcgaactcctgtgcccaaaagatcctcccacctcagcctcccaacatgccaggattacaggcatgagccaccctgcccagctcaataacctaagttctatgaatgaaaaccatgactgcctgtggagtgagggggccgtcaggctggtggggagctgggtgaagacccagccagcccaggccagctcaggtgacctaatccccccagctcccacttccccctccccaagtggtttggccgcagaataagaacagtgctgggggtgctgaaagaggggacgcaaggctggggcaatgcagtgggacccgggggtgtcaggacaagcaagcagcccttaccatgtctgtgtagatctcgattgctcgcatcaaaca

SEQ ID NO: 375630 - DNA, 1031 bp, Homo sapiens
ctacccaacctacgactctctaagcgacctgaaccgccgggtgcccggccgttgcgcgggctgatgacgtacggaagctgccggcgttgccctctcccaagatggcggccaggtcgcctgctcgggcctcccaggcgactttgccccactgcgcccgcgctctcttctcctttccatttctggaccaaggggctgccataaggagtctgtgactagagatgggaggtggtggccacggcctctcgctgtatgctgtgtggaaggtcgaatcatcatcatcataaaacttaatattgcccttatgtgccaggaactactatctcagcaatggagatgtggtgcttggccgcaatcgtgaatcggccctggaggggacacaggaaggggctgcctgcgactcatgacctcctgcgtgcctgcctgctgacctatgacccttcaagttcccacccctcagccacgcctgtgaggagggtcttgttttgtcgcctacgctggagtgcagtggtgtgatcacagctcactgcagcctcaacttcctggactcaagcgattttcctgcctcaacctcccaagaactaggaccccaggtgcatgccactacaccaggctaatttgttgtagagaggaggtcttgctatgttgcccaggctggtctcgaactcctgtgcccaaaagatcctcccacctcagcctcccaacatgccaggattacaggcatgagccaccctgcccagctcaataacctaagttctatgaatgaaaaccatgactgcctgtggagtgagggggccgtcaggctggtggggagctgggtgaagacccagccagcccaggccagctcaggtgacctaatccccccagctcccacttccccctccccaagtggtttggccgcagaataagaacagtgctgggggtgctgaaagaggggacgcaaggctggggcaatgcagtgggacccgggggtgtcaggacaagcaagcagcccttaccatgtctgtgtagatctcgattgctcgcatcaaaca

SEQ ID NO: 375631 - DNA, 700 bp, Homo sapiens
aaggggcaactgagattaaaccacataacatcttcccatctactcccctttccaagtcctgtttctttttccacagctccccaaagctcttcctgattctcccaactcctctgcctctgttcacattctgttcccttcactgcagatccccatggacaaggcacttgcatgaattgtgaggctcatggagttggggtcggacaacacagagccggctccctccaggagctgcatgtccagagagggaaacaggatgtggacagcaagaatgaatacatgcagaccagtgcccatgggcggagggcagaagagaccgcgcctgaagcctcatccatcctgtgctcatctgcacacggtcagcttctgtgggtcccaagccattctgcccacacatctcctaactgacgtttgggaggcagcagcatctctcctcctcctcgtgcagctgaccacctccagctcagctctgaggcttctccccttcattctcctccagctgaatctgagtcagagtttctaagctggaagaggaccaggaggcctggccctatcctcttaagttttgagcagcagaaaagacaaagccttccgggttttcactatatgatttcattattttcaagagttccaaatttgagtataaaattacggccaggcgcggtggctcatgcctgtaatcccagcactttgggaggccgag

SEQ ID NO: 375632 - DNA, 423 bp, Homo sapiens
ctccctatttaacaccctcccactaatgctttgcatcctaaaccttctccccagcactctatcccccaacaccttatttcttcaaaatgctttctccccaacacaaacccctcctaaaccccattgtccccaaccccgcatacctctaacacccttcatttgtgacaccaatccaccctcatctccctcttgcatgctttacctgtcccacacccatgccaatgtgccaagtctcccttggggacccagctgagtctgggtgttcccattgggttgggccaggcaaggcctctggtgcccgctgccgtccccctgcagtgggctctgctaggcctgtgctgagcaacagctgttattgtcatggtttataaacaataaactgtgatgccaggcacatctctgccttccctgaaaaaaatcatt

SEQ ID NO: 375633 - DNA, 1076 bp, Homo sapiens
ggggcaagctcaaacgcagggctgacagggagggatggccccacagccggctgcacagtgcccctgccaccccgcctgggcatctgcctggactatgagcggggccgggtttccttcctggatgctgtttccttccgtgggctcttggagtgccccctggactgctcagggcctgtgtgccctgccttttgcttcatcgggggtggcgcagtacagctccaggagccagtgggcactaagcctgagaggaaagtcaccattgggggcttcgccaagctggactgagccttccaggcccctcatgcagacctggggtcctcctgggccctggcccccaaacctcttggcacccggttgttaccccctggcagcttctcccccaaactctcctaccatgtggccctgctccttctcccgtgtctgtcttcccacagttttctcttgacccaggggctctcttctgcccacctctctggatggcccccgttctctccattgcttgttagccaggcccccacccccactgagtctgccctatgacctgcctttggcatgttacccaagccatggagagagccccttctccatccctgtcctgtgccccccaggctgattgggagggagggcacctggaacactgggcatgatctccagctctgcccttgccctgccaagctccctgccctgttgatgctgaactacagccttgggacaggcaggctttggggctggacgctgtccaggcattcctggtgaggggaaggggaccctgtcatcctgctttatttatttgggtcccaacaccccgcagccgcatgccccttatgtccctcttctccctcttgcatgctttacctgtcccacacccatgccaatgtgccaagtctcccttggggacccagctgagtctgggtgttcccattgggttgggccaggcaaggcctctggtgcccgctgccgtccccctgcagtgggctctgctaggcctgtgctgagcaacagctgttattgtcatggtttataaacaataaactgtgatgccaggcacatctctgccttccctgaaaaaaatcatt

SEQ ID NO: 375634 - DNA, 510 bp, Homo sapiens
cgaagcccgaggagatattgggagctaaccccggggcagtctccagggtcttggcctctctgggcctgggaccggttccaacactctcctggcattgggagccacagttgcagatcccccgaggccagaagccagcactgggccccctgcataaagttaagcatctcagagaatcccctgggcgacagagtgagactccatctgaaaaaaaaaaaaaaaaaaaaaaagactcaggggctgttactcagggagcacttgttagaacaatgaccaggggcaaactccggctggatgactggaaagctgccccaaggactggggcagagtgtggaaccggaatctctggaaacaagtcttttttttatttgtcttaatcaaacaaaagagatttctaagttttttgcgttccttaaaagtgaaggctttgtcaaacatttttgtctactctgggaaatgtacaatgattagaaaagtgcatgtcataatagtttccttttttttctttgagac

SEQ ID NO: 375635 - DNA, 417 bp, Homo sapiens
gtgtgctctgggccatctgcctctctcatccccatggcttgtgctcaggctactctactgggaacaaggagagaaatgaccacttctgacccagtagggatgttagctcctgaataccttgtctacttccccctactccctgcttctggctgtaccccccgccctgcaactgtggtcagtgtgtctggaagtattcaatgcacaatggattatgattatgattacatgtgtctgtgttttccactggaatctgagggacagaatacttgggcaatcagaagggagccacctaagccttctgcaaaaaccaccaccctttgagttttcaaaaagtttcagcaggggtcaagttctacttctttccggaacctgacctgggtcccgtactcattagagtaatctccaagccagtggtta

SEQ ID NO: 375636 - DNA, 747 bp, Homo sapiens
tgaatatcatcagcttacttgtctggcaagggcagaagcctggggttggcctgaactctgccaaacaaatatcaaagtgtatttaatagttaaatttgtgccctttcccttcttgctgcacccatgttgtcacttaacccccaggagttatttattatctttttgtcaaagtcaggctcatttggggtaatgtgatgactgtttaggtttacatgaccctcctctcctttccctacccccaaatatgtatatatacatatataaaatatgtatatattttacctatataaaatatatatatatatacacatatatgtatctatattcctttgtttctttgcctgcttatactggccataaaagagggagctgccttcaatgtataaagtataagaagagtgccagggaatgccataatggaggtttttggatctgaatttggaccatttcactaaagagaacatgagtttgctcaaccctttcctcacaagagggagggccccggttccccagacttctccacgcactggctccataaaggccagctttggccaggctgccacaggggcctgaggagctcactctgggcctacctggtttcagttagagggtcctcctgttatttttccatttaaaaagtatgtcctcataaaactgtactggaaggatgggtggcaggaacttgtatagttcagcttccaacactttggaacagattaaaaagggaatcttttaaataaaaactta

SEQ ID NO: 375637 - DNA, 1001 bp, Homo sapiens
taatcttaaggctgctgtatctgccatataacaaaagtgaagaaaatctaccctcttattctatgtgggatgtgaaaatctaacatatggaagacatttggggataattattaagtcacctaggttaaaatttgtgggcagtggtgcttaaatctagcacattatgaatactcaaattggataaccactaagtatactgaaattggtttattttataaaactttttattaaaagcttaattttttcatccagaattcctagtatcccaaattgtcctaggcagctatacccttctgatagtgatggtaaatctttgataagccgataaacaatgtggactttctagaggtatataacagtaatatttcacttccaattcccagctcttctcccatttctcctaccttctggaccaatgaggacaaacagaattgaagtttaattccactgcacaagtatcttctcaaatctgtgaaatctaccccttttacactataccattccactgctactagttcagctcttattgcctagattatacagccttttaactaatctcactgcttaataaacatgttttcttctagtctgtctgcttcactgcattctaaggtatctttcttaaaatggaactttgatttaaaaatcttccagtagcttcaagaatcagcctataaaattctgacttcttaaagaccctttgtgatccaatctagaccatgcctctttctagccaccacccctcatctttcttgataagaaatgaaggtactccttatttatttttcaccttaggagttctgaactgtgaactgagttccaagtaatgtccctatacctagaacattctctgcctcctactcttcctggctcccttatcttttaagacccatttatggcaatttgaggccatcactatcttttccaatctggattaggtgcccttcctgctagtacatgtcacactgtattgcaacagtccttccttgtctacttccttc

SEQ ID NO: 375638 - DNA, 859 bp, Homo sapiens
gcccccttcggagggactgagctttcacctgcgaatcagcgtcttactggcacttggagaatgtgaatgacaatgtacttgactgcggcttttcctctccccccttcagaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattagggtaatgcagaactgggctgggtgggtttgggggaaaaatggaggatagatgaataagaatagaattatgtgtttattgctttgcgatagattcctctgacacttttacttttaatgcccctagaggtcagcaggaaggcgcctatctttgggtgggtttctatgtgcccgaatcctactacagctgcagaataagtgccttcaagcagctggttcctttttgtaaatccctccctcttggaactgcctggtgcaccagggcccgcctaatctgtccaatatactgctctttgttccctcgcagactctagtagacggtcctaatagctgcttcttgggcataaataggatgtgagatcactgacagcctggcacgcagccctttggtacctcttcttcctatgtgttttacagaaagcagcactttggagatagtgattgcgtttgaaaccagcattattgggaaaagaatcgtttaagtaatcgattccatttttaaggttttgctttcaaatattcaaaagtatcagagcacactttttttaaaaagagcttatttg

SEQ ID NO: 375639 - DNA, 2796 bp, Homo sapiens
  misc_feature (2765)..(2765): n is a, c, g, or t
  misc_feature (2789)..(2789): n is a, c, g, or t
agcgggtgcggggcgggaccggcccggcctatatattgggttggcgccggcgccagctgagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagtaaagttttgccattgcttggagaaacttttttttcncttctctgcgctgccagctgtaancacttct

SEQ ID NO: 375640 - DNA, 2880 bp, Homo sapiens
ctccgggccgcgaggctccgtctccccggcgcggcccgctcgccgtccggctcgctcagggcctgggcagacgcggccgcccgagctaccgcgggttccgagacgccttcgcactgctcctccacccgggggatctttgttcccggagctgttccccgcctcgctgctcccgccgcaaaacctgtttgcggaatacccgccgcaagtctgacttgacgatgtgcagttttgggaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagta

SEQ ID NO: 375641 - DNA, 2745 bp, Homo sapiens
ctccgggccgcgaggctccgtctccccggcgcggcccgctcgccgtccggctcgctcagggcctgggcagacgcggccgcccgagctaccgcgggttccgagacgccttcgcactgctcctccacccgggggatctttgttcccggagctgttccccgcctcgctgctcccgccgcaaaacctgtttgcggaatacccgccgcaagtctgacttgacgatgtgcagttttgggaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttattttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagta

SEQ ID NO: 375642 - DNA, 2676 bp, Homo sapiens
agcgggtgcggggcgggaccggcccggcctatatattgggttggcgccggcgccagctgagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaagaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagta

SEQ ID NO: 375643 - DNA, 2162 bp, Homo sapiens
ctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagta

SEQ ID NO: 375644 - DNA, 357 bp, Homo sapiens
atccctaaggttttagcaagagacatttagtactcatctttctcctaaattgcttgtacttttgtttttcctgttagcttttagatctgtgtattctagccattgattcattagagttccagtacagaatactgactgctgctgccttgtgccattttacctccattgaagtggttaagaaagcctcaggtaagactctctatttgttgtcttcttaccttttcacaacttctaatgggactacagtctctgaactttaacattctgctaaacatgcatttaaaactttggcaaaaaaaaaattagctgttcagtaattatctttctgttagaagtactttccaatcctgaatgtgt

SEQ ID NO: 375645 - DNA, 2730 bp, Homo sapiens
agcgggtgcggggcgggaccggcccggcctatatattgggttggcgccggcgccagctgagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagta

SEQ ID NO: 375646 - DNA, 2524 bp, Homo sapiens
agcgggtgcggggcgggaccggcccggcctatatattgggttggcgccggcgccagctgagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagta

SEQ ID NO: 375647 - DNA, 1558 bp, Homo sapiens
agcgggtgcggggcgggaccggcccggcctatatattgggttggcgccggcgccagctgagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagctcttctcccatttctcctaccttctggaccaatgaggacaaacagaattgaagtttaattccactgcacaagtatcttctcaaatctgtgaaatctaccccttttacactataccattccactgctactagttcagctcttattgcctagattatacagccttttaactaatctcactgcttaataaacatgttttcttctagtctgtctgcttcactgcattctaaggtatctttcttaaaatggaactttgatttaaaaatcttccagtagcttcaagaatcagcctataaaattctgacttcttaaagaccctttgtgatccaatctagaccatgcctctttctagccaccacccctcatctttcttgataagaaatgaaggtactccttatttatttttcaccttaggagttctgaactgtgaactgagttccaagtaatgtccctatacctagaacattctctgcctcctactcttcctggctcccttatcttttaagacccatttatggcaatttgaggccatcactatcttttccaatctggattaggtgcccttcctgctagtacatgtcacactgtattgcaacagtccttccttgtctacttccttc

SEQ ID NO: 375648 - DNA, 2578 bp, Homo sapiens
agcgggtgcggggcgggaccggcccggcctatatattgggttggcgccggcgccagctgagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagta

SEQ ID NO: 375649 - DNA, 241 bp, Homo sapiens
cccgctttaaccagtgcaacacgacacgcggcaacgaggtcatctccgtgatgaatcgggccaagaaagcaggtgagctggggcccgctgtggggtcagggccaggtgacagacctctatcgcatatcctgacctctatcaccctcaggaaagtcagtgggagtggtaaccaccacacgggtgcagcatgcctcgccagccggcgcctacgcccacacggtgaaccgcaactggtactcgg

SEQ ID NO: 375650 - DNA, 2500 bp, Homo sapiens
catactccatacctgggatttccgcctcgccgctctccgactgcttccagacatgcaggggccctgggtgctgctcctgctgggcctgaggctacagctctccctgggcatcatcccagttgaggaggagaacccggacttctggaaccgccaggcagccgaggccctgggtgccgccaagaagctgcagcctgcacagacagccgccaagaacctcatcatcttcctgggtgacgggatgggggtgtctacggtgacagctgccaggatcctaaaagggcagaagaaggacaaactggggcctgagaccttcctggccatggaccgcttcccgtacgtggctctgtccaagacatacagtgtagacaagcatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcaggaaagtcagtgggagtggtaaccaccacacgggtgcagcatgcctcgccagccggcgcctacgcccacacggtgaaccgcaactggtactcggatgccgacgtgcctgcctcggcccgccaggaggggtgccaggacatcgccacgcagctcatctccaacatggacattgatgtgatcctaggtggaggccgaaagtacatgtttcccatggggaccccagaccctgagtacccagatgactacagccaaggtgggaccaggctggacgggaagaatctggtgcaggaatggctggcgaagcaccagggtgcccggtacgtgtggaaccgcactgagctcctgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacggagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccgcgccggcaccaccgacgccgcgcacccggggccgtccgtggtccccgcgttgcttcctctgctggcagggaccttgctgctgctggggacggccactgctccctgagtgtcccgtccctggggctcctgcttccccatcccggagttcccctgctccccacctccagtcgtcctgccggacctccacctggagctgtcacccccggagtcgccacacagacgtcctgccatggaaccttcccctcccggtgcaccctggggaccgagcccttgacaccacgccctttgctttatcttgctcttgaaattttggccccaactccagggactggggatttgtgcctggcagctgcctgcatttcaggaaaagaggaggctcagaccatccagcccccgcccatatcctgaggtggatcaggcaggctctctccccggggacatgaggcacccatacctaggaccccctgcgccttttttagcttcagtcatggcagcacctgagggacacaaggacttgggtgcatcaggacgccttggagaagcgtggcttcctgccaccctgcaacccaccctcccagccaaggaggctgctgtggtggggatccccaggggggctttgacacagtcctctgctgtccctccactgggctaattctacacccctgtgcccctcctaggggcccatgagtcagagaggcttgccccaagtcacagccactcagatgttcgacgccccctaaggtccattccagcacccacctgagttccgaggagcacctgggaagctctgggtgcaggatagcagtccagagtccatggccccgcctaggccatctgggtgctgggcatggatttctcagcaaggaagactcattaccttccctccctgggcctccattcttctgggaaacacaaagcaataataaaaggaagtgttagacaatgtaaaaaacag

SEQ ID NO: 375651 - DNA, 2673 bp, Homo sapiens
gtgcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaaccgcatgtctatctcaaaccgcagaaaggctttaatactggaaaaaaagaattcaagactacaggcagctcccctctgtaccccaactcatttaaaataggaggaatcactttttgccttacttaacgcttttttctgagcacagggatgggcacctgcaccccagaaggtgtgagctgtctctctgccaggagctaaggttcattaggggattggatggtttatcacttctttctttctgagtttacttttagtaacttttattgatggctacctttcatgtccctgtctaaagagactttctctttcatacgtcttaaatctcatcaatgaaatccagtgaaacagcaccatttcttagtatcattaaataactagaaagtatc

SEQ ID NO: 375652 - DNA, 6864 bp, Homo sapiens
gtgcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaaccgcatgtctatctcaaaccgcagaaaggctttaatactggaaaaaaagaattcaagactacaggcagctcccctctgtaccccaactcatttaaaataggaggaatcactttttgccttacttaacgcttttttctgagcacagggatgggcacctgcaccccagaaggtgtgagctgtctctctgccaggagctaaggttcattaggggattggatggtttatcacttctttctttctgagtttacttttagtaacttttattgatggctacctttcatgtccctgtctaaagagactttctctttcatacgtcttaaatctcatcaatgaaatccagtgaaacagcaccatttcttagtatcattaaataactagaaagtatcaagtattgctctctgctgctttatatcattaacatattaataataccaagaaggaaatactttgaataagtgtcagattctgatccagtattggacacctgtgatattggacacctgtgaggctgggataattacttttgaattacacctcttctctagtttctggaccttgctctgtcactttaacacagggtgatcaaacctgaatgaggatcagaactcacccaggcacatactaaagcaagattcctaaacctcagttccaggggtaattctgacatcacccgtccagcatagtcagctgaaattataaatctaagaaacagttacatcaagattctgctgtgtcatttaattctgaaactcccagtattctacccttcttcatcactgcatattaccccactcttccatcccaaattggctatcctttcagcccaccaacttagcggcagcactagggattcattataaggtaaatctggtttacataaagacctgaaggaggcctgtatttgaagctcacacttggtattggtatctctcatttttactgagccagtgtggaataccactgtatgtactcatataagcccttgacttttactgctcatcaggattggaatattactctagcagtcttcacacataggcaagttacagtccttttaaaaagtatctcatttccctataatggaacctaatagccaactttttcatagaaattgctagaagagtttgatcaactataaatgataaagtgtttataagcatagtcagtgtgacacagaaaccaatcttaaaattgaatttaatgttttatcatatcagattaaatattttctccatgtcttatttttactgcaacaagttagaaagtgggaacactttgattaatgtcttaaaatttgtgggccctcatttggataaaggcagcaatcctaaggactttttttttttttaacataatctgagaatttctctgtagagcagagactttcaaaccttttggctgtaacccacagtaaaaaacgcatttatatcaaaccttagaatatgtttaatgaacaatacttaccattctgatgctttttattgtttcagtttttaaaatatgccagttgcaacccactaaattgatatctaccaatgggttgcaacccttagcttgaaaaaaacaccctcacagaggaactggtatttcttgaataccttctgtttgccaggcacttcaccaggcattttacaagtaaggaaactgggcttcagagaaaataatttgcagaggtttactcaactacaaaggggtgaagccaggaatgttaactaggtctgttgagctacaaaaacttttatgtctctcagactatacagcctctatacaaaattgagatgggggttgggggcaggggctcatgcctgcaatcccagcacttagggaggcagaggccagaggatcacttgagcccaggagtttgagaccagcctgggcaacatagtgagactctgtctgtatgaaaaaaattaagaattagctgggtgtggcatagcacacacctgtggtcccagctacatgggaagctgaagtgggaggatcacttgaactcaggagcagccttggtgacagaacaagaccctctctcaaaaaaatatttaaaaaaaggtgggtcatccattctcctttaccaaacaggctttgaaatgacacattccattcatttgcatctttttaaaaaacttctgattccttactgagtgtccagcagcctcaaagtttttaatggtagctgatgcagacataaacagtgctcaatttggcccttaaactataaaatcaagaaagagtatttcaatcccatccacctgcctgcaagatttcttaatgttcactagttataaccattgtttaaacagtgctttttgtgtaatttaaaaataaactttaatgctttttaaaacaaatttatcataattcatagatcaaatgattatcctttaaaatgatacccttgggaaatcatgtacttactgtagtgatgctagtattaatattacttagaccaattttgaaactgttctttcagaattgcctccaaagacattttgcagatcatcccagaaaagggggtatgatggtgctgtgtagaactgaccagagttcctggaggattttgaggttatactgaaactgagtgctgtacagggagaattgcatgagtccagaaacttccttctgtgggctgcctgccttcctgccctcccttaagtgctctaagatttttgtacaggagtaagaatcaaatactggtaacatcaatcacaagaagttgaggaaacctgtaatatagctagataatatacaacgtttgtcttccatcagagtgcagaaaccaaaccatgctttgtgttaaccttaaatatgaaaggtgtttctcagggtcccctttgtccttcgttgctgccatatgaaatcttacaaggaaggatgaggaaaagcctggggggaggttctcctcggaaatgaggtggttttttttgttattaagtagaacgtggctgtggttcacaggtacttaacgaatgttagatgatgttcttaagtaatcagaggcctaataaaaggcaggggagtttctcttctagcctaaattaatattaaaagttcaggggtattttttgtttttaaattaatactttattgtttttaacaggtggttctcataatttacattcattaatttgatgcccttttacaaagaaacttcttaggtattataaaccatcaatgtaaaggatccacatggtatgtatccacattgctactctcaaatagaaatgggagataagaaatatatctgtgcaatattaaattgaaaaaaaaaacccataaaaagtgtcaaaggcaaataatttgctctagatcacaaaactagttagcacaaggctaggattataaccagggtctaggaaaaaatcctgaaggtgatttaactgagtgttaggccctgtcaagccacctgctaaggctcatggtctttcagactagcttcaacattccaaatcaggcaatagctacaacggaaagataattggacggggaatcctgagatcagagtcctagtttggctttgtctcttgtagcaggattttttaaatcaggggcagctctcttctcccatcccagccatgaatctttcaaccttagtggtcaccaacttgactccattccttatatcaagccttgtcctgtcaattctcccttaaatgttagttgcatccatttctaaatatatccatggccatcaccctagtaaaaagactattacctcacaccccgcacttgatcttcccccaactttaagtgactcagttccttatatcactgccacaagaattaacaaccatgtccatctttcatttttctgctgaaagattttcagtggttcccactgaataccaaataaagttcgaatcccttagattggcattcacagccttctacgttctggccccagctttatctcttgaaactcactactcaccatctgacaatgccactaaaaatccacaagagtgattttaaggtttttctatggtgaaggttcaaactggtaataaaccatgtttacatttttctggtctaaaataatttctatattactttataatagtcagctgggggttatttaagctcttggacgagcctaaaacttgtatcctgaagaaaatatttttttccaccagaagaaattgctttcaatttcttaaccttcaaaacaatgtcagtgttgtcacctgtgcatttgatagccacagcacaagtattcttcaggagcataaatcctccagccttgaatggaccattgtccagctcctgtgaaaaacttaatatttgagaaagacattcaatggtacatgttttctgtacacttcatgagtagttgagattttcttgtattaaggttaatcactaaaaaggtgtttacttgggtttcgttaactaaaccccctaaagatgttttccattttattgttaaacacttggtgttagcaagggtcagcacgagaaaaggcccaatggcaagaatttctgcaaactctgtaaagcttactgaattcatttgtcatttattacattgctgagtggtgcttgaataaggaaacatgcaataaatttacttatttaaccaa

SEQ ID NO: 375653 - DNA, 6936 bp, Homo sapiens
gtgcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggtatgttaaaaaatgttttctttttggtagttgtgaggcataaaagtaacttcctctccctttcttttaaaggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaaccgcatgtctatctcaaaccgcagaaaggctttaatactggaaaaaaagaattcaagactacaggcagctcccctctgtaccccaactcatttaaaataggaggaatcactttttgccttacttaacgcttttttctgagcacagggatgggcacctgcaccccagaaggtgtgagctgtctctctgccaggagctaaggttcattaggggattggatggtttatcacttctttctttctgagtttacttttagtaacttttattgatggctacctttcatgtccctgtctaaagagactttctctttcatacgtcttaaatctcatcaatgaaatccagtgaaacagcaccatttcttagtatcattaaataactagaaagtatcaagtattgctctctgctgctttatatcattaacatattaataataccaagaaggaaatactttgaataagtgtcagattctgatccagtattggacacctgtgatattggacacctgtgaggctgggataattacttttgaattacacctcttctctagtttctggaccttgctctgtcactttaacacagggtgatcaaacctgaatgaggatcagaactcacccaggcacatactaaagcaagattcctaaacctcagttccaggggtaattctgacatcacccgtccagcatagtcagctgaaattataaatctaagaaacagttacatcaagattctgctgtgtcatttaattctgaaactcccagtattctacccttcttcatcactgcatattaccccactcttccatcccaaattggctatcctttcagcccaccaacttagcggcagcactagggattcattataaggtaaatctggtttacataaagacctgaaggaggcctgtatttgaagctcacacttggtattggtatctctcatttttactgagccagtgtggaataccactgtatgtactcatataagcccttgacttttactgctcatcaggattggaatattactctagcagtcttcacacataggcaagttacagtccttttaaaaagtatctcatttccctataatggaacctaatagccaactttttcatagaaattgctagaagagtttgatcaactataaatgataaagtgtttataagcatagtcagtgtgacacagaaaccaatcttaaaattgaatttaatgttttatcatatcagattaaatattttctccatgtcttatttttactgcaacaagttagaaagtgggaacactttgattaatgtcttaaaatttgtgggccctcatttggataaaggcagcaatcctaaggactttttttttttttaacataatctgagaatttctctgtagagcagagactttcaaaccttttggctgtaacccacagtaaaaaacgcatttatatcaaaccttagaatatgtttaatgaacaatacttaccattctgatgctttttattgtttcagtttttaaaatatgccagttgcaacccactaaattgatatctaccaatgggttgcaacccttagcttgaaaaaaacaccctcacagaggaactggtatttcttgaataccttctgtttgccaggcacttcaccaggcattttacaagtaaggaaactgggcttcagagaaaataatttgcagaggtttactcaactacaaaggggtgaagccaggaatgttaactaggtctgttgagctacaaaaacttttatgtctctcagactatacagcctctatacaaaattgagatgggggttgggggcaggggctcatgcctgcaatcccagcacttagggaggcagaggccagaggatcacttgagcccaggagtttgagaccagcctgggcaacatagtgagactctgtctgtatgaaaaaaattaagaattagctgggtgtggcatagcacacacctgtggtcccagctacatgggaagctgaagtgggaggatcacttgaactcaggagcagccttggtgacagaacaagaccctctctcaaaaaaatatttaaaaaaaggtgggtcatccattctcctttaccaaacaggctttgaaatgacacattccattcatttgcatctttttaaaaaacttctgattccttactgagtgtccagcagcctcaaagtttttaatggtagctgatgcagacataaacagtgctcaatttggcccttaaactataaaatcaagaaagagtatttcaatcccatccacctgcctgcaagatttcttaatgttcactagttataaccattgtttaaacagtgctttttgtgtaatttaaaaataaactttaatgctttttaaaacaaatttatcataattcatagatcaaatgattatcctttaaaatgatacccttgggaaatcatgtacttactgtagtgatgctagtattaatattacttagaccaattttgaaactgttctttcagaattgcctccaaagacattttgcagatcatcccagaaaagggggtatgatggtgctgtgtagaactgaccagagttcctggaggattttgaggttatactgaaactgagtgctgtacagggagaattgcatgagtccagaaacttccttctgtgggctgcctgccttcctgccctcccttaagtgctctaagatttttgtacaggagtaagaatcaaatactggtaacatcaatcacaagaagttgaggaaacctgtaatatagctagataatatacaacgtttgtcttccatcagagtgcagaaaccaaaccatgctttgtgttaaccttaaatatgaaaggtgtttctcagggtcccctttgtccttcgttgctgccatatgaaatcttacaaggaaggatgaggaaaagcctggggggaggttctcctcggaaatgaggtggttttttttgttattaagtagaacgtggctgtggttcacaggtacttaacgaatgttagatgatgttcttaagtaatcagaggcctaataaaaggcaggggagtttctcttctagcctaaattaatattaaaagttcaggggtattttttgtttttaaattaatactttattgtttttaacaggtggttctcataatttacattcattaatttgatgcccttttacaaagaaacttcttaggtattataaaccatcaatgtaaaggatccacatggtatgtatccacattgctactctcaaatagaaatgggagataagaaatatatctgtgcaatattaaattgaaaaaaaaaacccataaaaagtgtcaaaggcaaataatttgctctagatcacaaaactagttagcacaaggctaggattataaccagggtctaggaaaaaatcctgaaggtgatttaactgagtgttaggccctgtcaagccacctgctaaggctcatggtctttcagactagcttcaacattccaaatcaggcaatagctacaacggaaagataattggacggggaatcctgagatcagagtcctagtttggctttgtctcttgtagcaggattttttaaatcaggggcagctctcttctcccatcccagccatgaatctttcaaccttagtggtcaccaacttgactccattccttatatcaagccttgtcctgtcaattctcccttaaatgttagttgcatccatttctaaatatatccatggccatcaccctagtaaaaagactattacctcacaccccgcacttgatcttcccccaactttaagtgactcagttccttatatcactgccacaagaattaacaaccatgtccatctttcatttttctgctgaaagattttcagtggttcccactgaataccaaataaagttcgaatcccttagattggcattcacagccttctacgttctggccccagctttatctcttgaaactcactactcaccatctgacaatgccactaaaaatccacaagagtgattttaaggtttttctatggtgaaggttcaaactggtaataaaccatgtttacatttttctggtctaaaataatttctatattactttataatagtcagctgggggttatttaagctcttggacgagcctaaaacttgtatcctgaagaaaatatttttttccaccagaagaaattgctttcaatttcttaaccttcaaaacaatgtcagtgttgtcacctgtgcatttgatagccacagcacaagtattcttcaggagcataaatcctccagccttgaatggaccattgtccagctcctgtgaaaaacttaatatttgagaaagacattcaatggtacatgttttctgtacacttcatgagtagttgagattttcttgtattaaggttaatcactaaaaaggtgtttacttgggtttcgttaactaaaccccctaaagatgttttccattttattgttaaacacttggtgttagcaagggtcagcacgagaaaaggcccaatggcaagaatttctgcaaactctgtaaagcttactgaattcatttgtcatttattacattgctgagtggtgcttgaataaggaaacatgcaataaatttacttatttaaccaa

SEQ ID NO: 375654 - DNA, 6753 bp, Homo sapiens
atcctttagggtcttactcttatgattcattaggcttaactatagcgctgctcagtctgtggctaattatttctcatcatgggggcaaaacctttttgagtgcactactcaatgccctgtgaattaagagttttcccattttggctggtggcaacaggcagtgtctccagtgttgacaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaaccgcatgtctatctcaaaccgcagaaaggctttaatactggaaaaaaagaattcaagactacaggcagctcccctctgtaccccaactcatttaaaataggaggaatcactttttgccttacttaacgcttttttctgagcacagggatgggcacctgcaccccagaaggtgtgagctgtctctctgccaggagctaaggttcattaggggattggatggtttatcacttctttctttctgagtttacttttagtaacttttattgatggctacctttcatgtccctgtctaaagagactttctctttcatacgtcttaaatctcatcaatgaaatccagtgaaacagcaccatttcttagtatcattaaataactagaaagtatcaagtattgctctctgctgctttatatcattaacatattaataataccaagaaggaaatactttgaataagtgtcagattctgatccagtattggacacctgtgatattggacacctgtgaggctgggataattacttttgaattacacctcttctctagtttctggaccttgctctgtcactttaacacagggtgatcaaacctgaatgaggatcagaactcacccaggcacatactaaagcaagattcctaaacctcagttccaggggtaattctgacatcacccgtccagcatagtcagctgaaattataaatctaagaaacagttacatcaagattctgctgtgtcatttaattctgaaactcccagtattctacccttcttcatcactgcatattaccccactcttccatcccaaattggctatcctttcagcccaccaacttagcggcagcactagggattcattataaggtaaatctggtttacataaagacctgaaggaggcctgtatttgaagctcacacttggtattggtatctctcatttttactgagccagtgtggaataccactgtatgtactcatataagcccttgacttttactgctcatcaggattggaatattactctagcagtcttcacacataggcaagttacagtccttttaaaaagtatctcatttccctataatggaacctaatagccaactttttcatagaaattgctagaagagtttgatcaactataaatgataaagtgtttataagcatagtcagtgtgacacagaaaccaatcttaaaattgaatttaatgttttatcatatcagattaaatattttctccatgtcttatttttactgcaacaagttagaaagtgggaacactttgattaatgtcttaaaatttgtgggccctcatttggataaaggcagcaatcctaaggactttttttttttttaacataatctgagaatttctctgtagagcagagactttcaaaccttttggctgtaacccacagtaaaaaacgcatttatatcaaaccttagaatatgtttaatgaacaatacttaccattctgatgctttttattgtttcagtttttaaaatatgccagttgcaacccactaaattgatatctaccaatgggttgcaacccttagcttgaaaaaaacaccctcacagaggaactggtatttcttgaataccttctgtttgccaggcacttcaccaggcattttacaagtaaggaaactgggcttcagagaaaataatttgcagaggtttactcaactacaaaggggtgaagccaggaatgttaactaggtctgttgagctacaaaaacttttatgtctctcagactatacagcctctatacaaaattgagatgggggttgggggcaggggctcatgcctgcaatcccagcacttagggaggcagaggccagaggatcacttgagcccaggagtttgagaccagcctgggcaacatagtgagactctgtctgtatgaaaaaaattaagaattagctgggtgtggcatagcacacacctgtggtcccagctacatgggaagctgaagtgggaggatcacttgaactcaggagcagccttggtgacagaacaagaccctctctcaaaaaaatatttaaaaaaaggtgggtcatccattctcctttaccaaacaggctttgaaatgacacattccattcatttgcatctttttaaaaaacttctgattccttactgagtgtccagcagcctcaaagtttttaatggtagctgatgcagacataaacagtgctcaatttggcccttaaactataaaatcaagaaagagtatttcaatcccatccacctgcctgcaagatttcttaatgttcactagttataaccattgtttaaacagtgctttttgtgtaatttaaaaataaactttaatgctttttaaaacaaatttatcataattcatagatcaaatgattatcctttaaaatgatacccttgggaaatcatgtacttactgtagtgatgctagtattaatattacttagaccaattttgaaactgttctttcagaattgcctccaaagacattttgcagatcatcccagaaaagggggtatgatggtgctgtgtagaactgaccagagttcctggaggattttgaggttatactgaaactgagtgctgtacagggagaattgcatgagtccagaaacttccttctgtgggctgcctgccttcctgccctcccttaagtgctctaagatttttgtacaggagtaagaatcaaatactggtaacatcaatcacaagaagttgaggaaacctgtaatatagctagataatatacaacgtttgtcttccatcagagtgcagaaaccaaaccatgctttgtgttaaccttaaatatgaaaggtgtttctcagggtcccctttgtccttcgttgctgccatatgaaatcttacaaggaaggatgaggaaaagcctggggggaggttctcctcggaaatgaggtggttttttttgttattaagtagaacgtggctgtggttcacaggtacttaacgaatgttagatgatgttcttaagtaatcagaggcctaataaaaggcaggggagtttctcttctagcctaaattaatattaaaagttcaggggtattttttgtttttaaattaatactttattgtttttaacaggtggttctcataatttacattcattaatttgatgcccttttacaaagaaacttcttaggtattataaaccatcaatgtaaaggatccacatggtatgtatccacattgctactctcaaatagaaatgggagataagaaatatatctgtgcaatattaaattgaaaaaaaaaacccataaaaagtgtcaaaggcaaataatttgctctagatcacaaaactagttagcacaaggctaggattataaccagggtctaggaaaaaatcctgaaggtgatttaactgagtgttaggccctgtcaagccacctgctaaggctcatggtctttcagactagcttcaacattccaaatcaggcaatagctacaacggaaagataattggacggggaatcctgagatcagagtcctagtttggctttgtctcttgtagcaggattttttaaatcaggggcagctctcttctcccatcccagccatgaatctttcaaccttagtggtcaccaacttgactccattccttatatcaagccttgtcctgtcaattctcccttaaatgttagttgcatccatttctaaatatatccatggccatcaccctagtaaaaagactattacctcacaccccgcacttgatcttcccccaactttaagtgactcagttccttatatcactgccacaagaattaacaaccatgtccatctttcatttttctgctgaaagattttcagtggttcccactgaataccaaataaagttcgaatcccttagattggcattcacagccttctacgttctggccccagctttatctcttgaaactcactactcaccatctgacaatgccactaaaaatccacaagagtgattttaaggtttttctatggtgaaggttcaaactggtaataaaccatgtttacatttttctggtctaaaataatttctatattactttataatagtcagctgggggttatttaagctcttggacgagcctaaaacttgtatcctgaagaaaatatttttttccaccagaagaaattgctttcaatttcttaaccttcaaaacaatgtcagtgttgtcacctgtgcatttgatagccacagcacaagtattcttcaggagcataaatcctccagccttgaatggaccattgtccagctcctgtgaaaaacttaatatttgagaaagacattcaatggtacatgttttctgtacacttcatgagtagttgagattttcttgtattaaggttaatcactaaaaaggtgtttacttgggtttcgttaactaaaccccctaaagatgttttccattttattgttaaacacttggtgttagcaagggtcagcacgagaaaaggcccaatggcaagaatttctgcaaactctgtaaagcttactgaattcatttgtcatttattacattgctgagtggtgcttgaataaggaaacatgcaataaatttacttatttaaccaa

SEQ ID NO: 375655 - DNA, 6932 bp, Homo sapiens
gattgacctgatgacctcaacattccttctacccagagattccatgagtcacagttgctgttgtgccagcacaggtgttgccattttatgtagaatgctttattaatatatttgatctgaaacattttaaactgtcatgattttaaaatgtattaagatacacaggtgtaaagcacagaacagtgatttcattcactgttccctactgcatattacaaatggaaagatctcataatagatcaaaccgtattgtagtcttgttcctgaaacataacaatttgtatttattggaccaagggcattttactcctaaggtaaatgtgcctgatttaaactgaatcctcaaagaaggtaagttagggaggtattttggggtttgattttgttgggttttttttttccatcaaacccaacatgacatgtaaatgcttatttggattttttttttctggaaagtagattcatttggagaataatatgtttgtatgtttgagtgaattttagcgtgagatgctttttgctgtaaagttgccacccttttattacctaataattaagacccccccccttttttttatgaaagttaatttgtcctttcgacatggcttatcagatgctattaatgaaccactattaagatggcaaggctgcagtacccagggccctgattacaggaattaaaatagtgtgtgttggctccctgctgctccccagcaggaccgctcactcataattcctttgcatctagtctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaaccgcatgtctatctcaaaccgcagaaaggctttaatactggaaaaaaagaattcaagactacaggcagctcccctctgtaccccaactcatttaaaataggaggaatcactttttgccttacttaacgcttttttctgagcacagggatgggcacctgcaccccagaaggtgtgagctgtctctctgccaggagctaaggttcattaggggattggatggtttatcacttctttctttctgagtttacttttagtaacttttattgatggctacctttcatgtccctgtctaaagagactttctctttcatacgtcttaaatctcatcaatgaaatccagtgaaacagcaccatttcttagtatcattaaataactagaaagtatcaagtattgctctctgctgctttatatcattaacatattaataataccaagaaggaaatactttgaataagtgtcagattctgatccagtattggacacctgtgatattggacacctgtgaggctgggataattacttttgaattacacctcttctctagtttctggaccttgctctgtcactttaacacagggtgatcaaacctgaatgaggatcagaactcacccaggcacatactaaagcaagattcctaaacctcagttccaggggtaattctgacatcacccgtccagcatagtcagctgaaattataaatctaagaaacagttacatcaagattctgctgtgtcatttaattctgaaactcccagtattctacccttcttcatcactgcatattaccccactcttccatcccaaattggctatcctttcagcccaccaacttagcggcagcactagggattcattataaggtaaatctggtttacataaagacctgaaggaggcctgtatttgaagctcacacttggtattggtatctctcatttttactgagccagtgtggaataccactgtatgtactcatataagcccttgacttttactgctcatcaggattggaatattactctagcagtcttcacacataggcaagttacagtccttttaaaaagtatctcatttccctataatggaacctaatagccaactttttcatagaaattgctagaagagtttgatcaactataaatgataaagtgtttataagcatagtcagtgtgacacagaaaccaatcttaaaattgaatttaatgttttatcatatcagattaaatattttctccatgtcttatttttactgcaacaagttagaaagtgggaacactttgattaatgtcttaaaatttgtgggccctcatttggataaaggcagcaatcctaaggactttttttttttttaacataatctgagaatttctctgtagagcagagactttcaaaccttttggctgtaacccacagtaaaaaacgcatttatatcaaaccttagaatatgtttaatgaacaatacttaccattctgatgctttttattgtttcagtttttaaaatatgccagttgcaacccactaaattgatatctaccaatgggttgcaacccttagcttgaaaaaaacaccctcacagaggaactggtatttcttgaataccttctgtttgccaggcacttcaccaggcattttacaagtaaggaaactgggcttcagagaaaataatttgcagaggtttactcaactacaaaggggtgaagccaggaatgttaactaggtctgttgagctacaaaaacttttatgtctctcagactatacagcctctatacaaaattgagatgggggttgggggcaggggctcatgcctgcaatcccagcacttagggaggcagaggccagaggatcacttgagcccaggagtttgagaccagcctgggcaacatagtgagactctgtctgtatgaaaaaaattaagaattagctgggtgtggcatagcacacacctgtggtcccagctacatgggaagctgaagtgggaggatcacttgaactcaggagcagccttggtgacagaacaagaccctctctcaaaaaaatatttaaaaaaaggtgggtcatccattctcctttaccaaacaggctttgaaatgacacattccattcatttgcatctttttaaaaaacttctgattccttactgagtgtccagcagcctcaaagtttttaatggtagctgatgcagacataaacagtgctcaatttggcccttaaactataaaatcaagaaagagtatttcaatcccatccacctgcctgcaagatttcttaatgttcactagttataaccattgtttaaacagtgctttttgtgtaatttaaaaataaactttaatgctttttaaaacaaatttatcataattcatagatcaaatgattatcctttaaaatgatacccttgggaaatcatgtacttactgtagtgatgctagtattaatattacttagaccaattttgaaactgttctttcagaattgcctccaaagacattttgcagatcatcccagaaaagggggtatgatggtgctgtgtagaactgaccagagttcctggaggattttgaggttatactgaaactgagtgctgtacagggagaattgcatgagtccagaaacttccttctgtgggctgcctgccttcctgccctcccttaagtgctctaagatttttgtacaggagtaagaatcaaatactggtaacatcaatcacaagaagttgaggaaacctgtaatatagctagataatatacaacgtttgtcttccatcagagtgcagaaaccaaaccatgctttgtgttaaccttaaatatgaaaggtgtttctcagggtcccctttgtccttcgttgctgccatatgaaatcttacaaggaaggatgaggaaaagcctggggggaggttctcctcggaaatgaggtggttttttttgttattaagtagaacgtggctgtggttcacaggtacttaacgaatgttagatgatgttcttaagtaatcagaggcctaataaaaggcaggggagtttctcttctagcctaaattaatattaaaagttcaggggtattttttgtttttaaattaatactttattgtttttaacaggtggttctcataatttacattcattaatttgatgcccttttacaaagaaacttcttaggtattataaaccatcaatgtaaaggatccacatggtatgtatccacattgctactctcaaatagaaatgggagataagaaatatatctgtgcaatattaaattgaaaaaaaaaacccataaaaagtgtcaaaggcaaataatttgctctagatcacaaaactagttagcacaaggctaggattataaccagggtctaggaaaaaatcctgaaggtgatttaactgagtgttaggccctgtcaagccacctgctaaggctcatggtctttcagactagcttcaacattccaaatcaggcaatagctacaacggaaagataattggacggggaatcctgagatcagagtcctagtttggctttgtctcttgtagcaggattttttaaatcaggggcagctctcttctcccatcccagccatgaatctttcaaccttagtggtcaccaacttgactccattccttatatcaagccttgtcctgtcaattctcccttaaatgttagttgcatccatttctaaatatatccatggccatcaccctagtaaaaagactattacctcacaccccgcacttgatcttcccccaactttaagtgactcagttccttatatcactgccacaagaattaacaaccatgtccatctttcatttttctgctgaaagattttcagtggttcccactgaataccaaataaagttcgaatcccttagattggcattcacagccttctacgttctggccccagctttatctcttgaaactcactactcaccatctgacaatgccactaaaaatccacaagagtgattttaaggtttttctatggtgaaggttcaaactggtaataaaccatgtttacatttttctggtctaaaataatttctatattactttataatagtcagctgggggttatttaagctcttggacgagcctaaaacttgtatcctgaagaaaatatttttttccaccagaagaaattgctttcaatttcttaaccttcaaaacaatgtcagtgttgtcacctgtgcatttgatagccacagcacaagtattcttcaggagcataaatcctccagccttgaatggaccattgtccagctcctgtgaaaaacttaatatttgagaaagacattcaatggtacatgttttctgtacacttcatgagtagttgagattttcttgtattaaggttaatcactaaaaaggtgtttacttgggtttcgttaactaaaccccctaaagatgttttccattttattgttaaacacttggtgttagcaagggtcagcacgagaaaaggcccaatggcaagaatttctgcaaactctgtaaagcttactgaattcatttgtcatttattacattgctgagtggtgcttgaataaggaaacatgcaataaatttacttatttaaccaa

SEQ ID NO: 375656 - DNA, 5372 bp, Homo sapiens
ttttacaagtaaggaaactgggcttcagagaaaataatttgcagaggtttactcaactacaaaggggtgaagccaggaatgttaactaggtctgttgagctacaaaaacttttatgtctctcagactatacagcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaaccgcatgtctatctcaaaccgcagaaaggctttaatactggaaaaaaagaattcaagactacaggcagctcccctctgtaccccaactcatttaaaataggaggaatcactttttgccttacttaacgcttttttctgagcacagggatgggcacctgcaccccagaaggtgtgagctgtctctctgccaggagctaaggttcattaggggattggatggtttatcacttctttctttctgagtttacttttagtaacttttattgatggctacctttcatgtccctgtctaaagagactttctctttcatacgtcttaaatctcatcaatgaaatccagtgaaacagcaccatttcttagtatcattaaataactagaaagtatcaagtattgctctctgctgctttatatcattaacatattaataataccaagaaggaaatactttgaataagtgtcagattctgatccagtattggacacctgtgatattggacacctgtgaggctgggataattacttttgaattacacctcttctctagtttctggaccttgctctgtcactttaacacagggtgatcaaacctgaatgaggatcagaactcacccaggcacatactaaagcaagattcctaaacctcagttccaggggtaattctgacatcacccgtccagcatagtcagctgaaattataaatctaagaaacagttacatcaagattctgctgtgtcatttaattctgaaactcccagtattctacccttcttcatcactgcatattaccccactcttccatcccaaattggctatcctttcagcccaccaacttagcggcagcactagggattcattataaggtaaatctggtttacataaagacctgaaggaggcctgtatttgaagctcacacttggtattggtatctctcatttttactgagccagtgtggaataccactgtatgtactcatataagcccttgacttttactgctcatcaggattggaatattactctagcagtcttcacacataggcaagttacagtccttttaaaaagtatctcatttccctataatggaacctaatagccaactttttcatagaaattgctagaagagtttgatcaactataaatgataaagtgtttataagcatagtcagtgtgacacagaaaccaatcttaaaattgaatttaatgttttatcatatcagattaaatattttctccatgtcttatttttactgcaacaagttagaaagtgggaacactttgattaatgtcttaaaatttgtgggccctcatttggataaaggcagcaatcctaaggactttttttttttttaacataatctgagaatttctctgtagagcagagactttcaaaccttttggctgtaacccacagtaaaaaacgcatttatatcaaaccttagaatatgtttaatgaacaatacttaccattctgatgctttttattgtttcagtttttaaaatatgccagttgcaacccactaaattgatatctaccaatgggttgcaacccttagcttgaaaaaaacaccctcacagaggaactggtatttcttgaataccttctgtttgccaggcacttcaccaggcattttacaagtaaggaaactgggcttcagagaaaataatttgcagaggtttactcaactacaaaggggtgaagccaggaatgttaactaggtctgttgagctacaaaaacttttatgtctctcagactatacagcctctatacaaaattgagatgggggttgggggcaggggctcatgcctgcaatcccagcacttagggaggcagaggccagaggatcacttgagcccaggagtttgagaccagcctgggcaacatagtgagactctgtctgtatgaaaaaaattaagaattagctgggtgtggcatagcacacacctgtggtcccagctacatgggaagctgaagtgggaggatcacttgaactcaggagcagccttggtgacagaacaagaccctctctcaaaaaaatatttaaaaaaaggtgggtcatccattctcctttaccaaacaggctttgaaatgacacattccattcatttgcatctttttaaaaaacttctgattccttactgagtgtccagcagcctcaaagtttttaatggtagctgatgcagacataaacagtgctcaatttggcccttaaactataaaatcaagaaagagtatttcaatcccatccacctgcctgcaagatttcttaatgttcactagttataaccattgtttaaacagtgctttttgtgtaatttaaaaataaactttaatgctttttaaaacaaatttatcataattcatagatcaaatgattatcctttaaaatgatacccttgggaaatcatgtacttactgtagtgatgctagtattaatattacttagaccaattttgaaactgttctttcagaattgcctccaaagacattttgcagatcatcccagaaaagggggtatgatggtgctgtgtagaactgaccagagttcctggaggattttgaggttatactgaaactgagtgctgtacagggagaattgcatgagtccagaaacttccttctgtgggctgcctgccttcctgccctcccttaagtgctctaagatttttgtacaggagtaagaatcaaatactggtaacatcaatcacaagaagttgaggaaacctgtaatatagctagataatatacaacgtttgtcttccatcagagtgcagaaaccaaaccatgctttgtgttaaccttaaatatgaaaggtgtttctcagggtcccctttgtccttcgttgctgccatatgaaatcttacaaggaaggatgaggaaaagcctggggggaggttctcctcggaaatgaggtggttttttttgttattaagtagaacgtggctgtggttcacaggtacttaacgaatgttagatgatgttcttaagtaatcagaggcctaataaaaggcaggggagtttctcttctagcctaaattaatattaaaagttcaggggtattttttgtttttaaattaatactttattgtttttaacaggtggttctcataatttacattcattaatttgatgcccttttacaaagaaacttcttaggtattataaaccatcaatgtaaaggatccacatggtatgtatccacattgctactctcaaatagaaatgggagataagaaatatatctgtgcaatattaaattgaaaaaaaaaacccataaaaagtgtcaaaggcaaataatttgctctagatcacaaaactagttagcacaaggctaggattataaccagggtctaggaaaaaatcctgaaggtgatttaactgagtgttaggccctgtcaagccacctgctaaggctcatggtctttcagactagcttcaacattccaaatcaggcaatagctacaacggaaagataattggacggggaatcctgagatcagagtcctagtttggctttgtctcttgtagcaggattttttaaatcaggggcagctctcttctcccatcccagccatgaatctttcaaccttagtggtcaccaacttgactccattccttatatcaagccttgtcctgtcaattctcccttaaatgttagttgcatccatttctaaatatatccatggccatcaccctagtaaaaagactattacctcacaccccgcacttgatcttcccccaactttaagtgactcagttccttatatcactgccacaagaattaacaaccatgtccatctttcatttttctgctgaaagattttcagtggttcccactgaataccaaataaagttcgaatcccttagattggcattcacagccttctacgttctggccccagctttatctcttgaaactcactactcaccatctgacaatgccactaaaaatccacaagagtgattttaaggtttttctatggtgaaggttcaaactggtaataaaccatgtttacatttttctggtctaaaataatttctatattactttataatagtcagctgggggttatttaagctcttggacgagcctaaaacttgtatcctgaagaaaatatttttttccaccagaagaaattgctttcaatttcttaaccttcaaaacaatgtcagtgttgtcacctgtgcatttgatagccacagcacaagtattcttcaggagcataaatcctccagccttgaatggaccattgtccagctcctgtgaaaaacttaatatttgagaaagacattcaatggtacatgttttctgtacacttcatgagtagttgagattttcttgtattaaggttaatcactaaaaaggtgtttacttgggtttcgttaactaaaccccctaaagatgttttccattttattgttaaacacttggtgttagcaagggtcagcacgagaaaaggcccaatggcaagaatttctgcaaactctgtaaagcttactgaattcatttgtcatttattacattgctgagtggtgcttgaataaggaaacatgcaataaatttacttatttaaccaa

SEQ ID NO: 375657 - DNA, 545 bp, Homo sapiens
gtgcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcaggccagaatgcctaattggcagagacacacttagcagctggcagaacccccacattggctccctgactggtagggtgagggcgatgatggtgggaaaagccaaatggaagccattagagctgcctctacctagaaaaatggtaagtcaaaaacaatatcgcatccttggagggactgcagagattagtgtcaccatcaaggacttgaaagacgcaagggtggtgattcccagcacatccccattctactctcctatctg

SEQ ID NO: 375658 - DNA, 840 bp, Homo sapiens
gtggtgcttgaataaggaaacatgcaataaatttacttatttaaccaacatttaactgaaggcctgtggtgtgttaagtgctggggccatacatagaaaaatactagacctatagaatctacccctgtaaaccattcaggctaatgaattcagatacctaaagcaagtaaatcacagtaaaacctggtaactgccctaagagaggaatgaacaaagtaatacgagggcacacagagtggagggaccaaattctgcttggaaaagaaggggcaggctttgtggaacatgtggtgtttgagccgtacctaaagaagaatatgcctgattgaagatggagttatggacaaagggctcaaaacacaacatggtgggctcacagaaaactaagaaacaaaacgcacctgagtgatgaagatggttggatggaaatacagactaggatgtgatctatttaaaatttaatacttctttgtttataggaattgatgtattgctttgtgtcagataagactattactcctctgagttcctcattttgccttcttgccagggaagttagtattaaacctcacatttggtggagttcttggtatatttggcatatttgccttcctttcccacaggttgtgctttcttccctctctgcttaagagatcatctgcttaacactgaatgccctctttgttcctgttctaatagtcattccatatttattgaaaacccactgagaaaacagtcatgaaatttacttattagtgtccaagtgcttcacaatcgttttccatctctacatgaacatttcttaaccactgcaattcatggctccagttttcacttatg

SEQ ID NO: 375659 - DNA, 337 bp, Homo sapiens
atcctgttaaagaagaagcatcagcagcaacagcagaatttctccaactccatttggaatctgtagaagaacttaagaagcaatttaatgatgaagaaactttgctacagcctcctttgaccagatccatgactgttggtggtaatgtattgtgctaagtcttattctcagtcacagtagtgcagttaattaaagatcacctccttgagtagatactgaattatctataggtcttcagagaccattcactatcccaatatgctgaatccttggaccctgatcagtgttcctggaaatgtgtaccctggatattttgcagaataaaaaatttaaggct

SEQ ID NO: 375660 - DNA, 5230 bp, Homo sapiens
  misc_feature (8)..(8): n is a, c, g, or t
  misc_feature (13)..(13): n is a, c, g, or t
actgctcnggtgntctcctccaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaaccgcatgtctatctcaaaccgcagaaaggctttaatactggaaaaaaagaattcaagactacaggcagctcccctctgtaccccaactcatttaaaataggaggaatcactttttgccttacttaacgcttttttctgagcacagggatgggcacctgcaccccagaaggtgtgagctgtctctctgccaggagctaaggttcattaggggattggatggtttatcacttctttctttctgagtttacttttagtaacttttattgatggctacctttcatgtccctgtctaaagagactttctctttcatacgtcttaaatctcatcaatgaaatccagtgaaacagcaccatttcttagtatcattaaataactagaaagtatcaagtattgctctctgctgctttatatcattaacatattaataataccaagaaggaaatactttgaataagtgtcagattctgatccagtattggacacctgtgatattggacacctgtgaggctgggataattacttttgaattacacctcttctctagtttctggaccttgctctgtcactttaacacagggtgatcaaacctgaatgaggatcagaactcacccaggcacatactaaagcaagattcctaaacctcagttccaggggtaattctgacatcacccgtccagcatagtcagctgaaattataaatctaagaaacagttacatcaagattctgctgtgtcatttaattctgaaactcccagtattctacccttcttcatcactgcatattaccccactcttccatcccaaattggctatcctttcagcccaccaacttagcggcagcactagggattcattataaggtaaatctggtttacataaagacctgaaggaggcctgtatttgaagctcacacttggtattggtatctctcatttttactgagccagtgtggaataccactgtatgtactcatataagcccttgacttttactgctcatcaggattggaatattactctagcagtcttcacacataggcaagttacagtccttttaaaaagtatctcatttccctataatggaacctaatagccaactttttcatagaaattgctagaagagtttgatcaactataaatgataaagtgtttataagcatagtcagtgtgacacagaaaccaatcttaaaattgaatttaatgttttatcatatcagattaaatattttctccatgtcttatttttactgcaacaagttagaaagtgggaacactttgattaatgtcttaaaatttgtgggccctcatttggataaaggcagcaatcctaaggactttttttttttttaacataatctgagaatttctctgtagagcagagactttcaaaccttttggctgtaacccacagtaaaaaacgcatttatatcaaaccttagaatatgtttaatgaacaatacttaccattctgatgctttttattgtttcagtttttaaaatatgccagttgcaacccactaaattgatatctaccaatgggttgcaacccttagcttgaaaaaaacaccctcacagaggaactggtatttcttgaataccttctgtttgccaggcacttcaccaggcattttacaagtaaggaaactgggcttcagagaaaataatttgcagaggtttactcaactacaaaggggtgaagccaggaatgttaactaggtctgttgagctacaaaaacttttatgtctctcagactatacagcctctatacaaaattgagatgggggttgggggcaggggctcatgcctgcaatcccagcacttagggaggcagaggccagaggatcacttgagcccaggagtttgagaccagcctgggcaacatagtgagactctgtctgtatgaaaaaaattaagaattagctgggtgtggcatagcacacacctgtggtcccagctacatgggaagctgaagtgggaggatcacttgaactcaggagcagccttggtgacagaacaagaccctctctcaaaaaaatatttaaaaaaaggtgggtcatccattctcctttaccaaacaggctttgaaatgacacattccattcatttgcatctttttaaaaaacttctgattccttactgagtgtccagcagcctcaaagtttttaatggtagctgatgcagacataaacagtgctcaatttggcccttaaactataaaatcaagaaagagtatttcaatcccatccacctgcctgcaagatttcttaatgttcactagttataaccattgtttaaacagtgctttttgtgtaatttaaaaataaactttaatgctttttaaaacaaatttatcataattcatagatcaaatgattatcctttaaaatgatacccttgggaaatcatgtacttactgtagtgatgctagtattaatattacttagaccaattttgaaactgttctttcagaattgcctccaaagacattttgcagatcatcccagaaaagggggtatgatggtgctgtgtagaactgaccagagttcctggaggattttgaggttatactgaaactgagtgctgtacagggagaattgcatgagtccagaaacttccttctgtgggctgcctgccttcctgccctcccttaagtgctctaagatttttgtacaggagtaagaatcaaatactggtaacatcaatcacaagaagttgaggaaacctgtaatatagctagataatatacaacgtttgtcttccatcagagtgcagaaaccaaaccatgctttgtgttaaccttaaatatgaaaggtgtttctcagggtcccctttgtccttcgttgctgccatatgaaatcttacaaggaaggatgaggaaaagcctggggggaggttctcctcggaaatgaggtggttttttttgttattaagtagaacgtggctgtggttcacaggtacttaacgaatgttagatgatgttcttaagtaatcagaggcctaataaaaggcaggggagtttctcttctagcctaaattaatattaaaagttcaggggtattttttgtttttaaattaatactttattgtttttaacaggtggttctcataatttacattcattaatttgatgcccttttacaaagaaacttcttaggtattataaaccatcaatgtaaaggatccacatggtatgtatccacattgctactctcaaatagaaatgggagataagaaatatatctgtgcaatattaaattgaaaaaaaaaacccataaaaagtgtcaaaggcaaataatttgctctagatcacaaaactagttagcacaaggctaggattataaccagggtctaggaaaaaatcctgaaggtgatttaactgagtgttaggccctgtcaagccacctgctaaggctcatggtctttcagactagcttcaacattccaaatcaggcaatagctacaacggaaagataattggacggggaatcctgagatcagagtcctagtttggctttgtctcttgtagcaggattttttaaatcaggggcagctctcttctcccatcccagccatgaatctttcaaccttagtggtcaccaacttgactccattccttatatcaagccttgtcctgtcaattctcccttaaatgttagttgcatccatttctaaatatatccatggccatcaccctagtaaaaagactattacctcacaccccgcacttgatcttcccccaactttaagtgactcagttccttatatcactgccacaagaattaacaaccatgtccatctttcatttttctgctgaaagattttcagtggttcccactgaataccaaataaagttcgaatcccttagattggcattcacagccttctacgttctggccccagctttatctcttgaaactcactactcaccatctgacaatgccactaaaaatccacaagagtgattttaaggtttttctatggtgaaggttcaaactggtaataaaccatgtttacatttttctggtctaaaataatttctatattactttataatagtcagctgggggttatttaagctcttggacgagcctaaaacttgtatcctgaagaaaatatttttttccaccagaagaaattgctttcaatttcttaaccttcaaaacaatgtcagtgttgtcacctgtgcatttgatagccacagcacaagtattcttcaggagcataaatcctccagccttgaatggaccattgtccagctcctgtgaaaaacttaatatttgagaaagacattcaatggtacatgttttctgtacacttcatgagtagttgagattttcttgtattaaggttaatcactaaaaaggtgtttacttgggtttcgttaactaaaccccctaaagatgttttccattttattgttaaacacttggtgttagcaagggtcagcacgagaaaaggcccaatggcaagaatttctgcaaactctgtaaagcttactgaattcatttgtcatttattacattgctgagtggtgcttgaataaggaaacatgcaataaatttacttatttaaccaa

SEQ ID NO: 375661 - DNA, 4628 bp, Homo sapiens
gtgcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaaccgcatgtctatctcaaaccgcagaaaggctttaatactggaaaaaaagaattcaagactacaggcagctcccctctgtaccccaactcatttaaaataggaggaatcactttttgccttacttaacgcttttttctgagcacagggatgggcacctgcaccccagaaggtgtgagctgtctctctgccaggagctaaggttcattaggggattggatggtttatcacttctttctttctgagtttacttttagtaacttttattgatggctacctttcatgtccctgtctaaagagactttctctttcatacgtcttaaatctcatcaatgaaatccagtgaaacagcaccatttcttagtatcattaaataactagaaagtatcaagtattgctctctgctgctttatatcattaacatattaataataccaagaaggaaatactttgaataagtgtcagattctgatccagtattggacacctgtgatattggacacctgtgaggctgggataattacttttgaattacacctcttctctagtttctggaccttgctctgtcactttaacacagggtgatcaaacctgaatgaggatcagaactcacccaggcacatactaaagcaagattcctaaacctcagttccaggggtaattctgacatcacccgtccagcatagtcagctgaaattataaatctaagaaacagttacatcaagattctgctgtgtcatttaattctgaaactcccagtattctacccttcttcatcactgcatattaccccactcttccatcccaaattggctatcctttcagcccaccaacttagcggcagcactagggattcattataaggtaaatctggtttacataaagacctgaaggaggcctgtatttgaagctcacacttggtattggtatctctcatttttactgagccagtgtggaataccactgtatgtactcatataagcccttgacttttactgctcatcaggattggaatattactctagcagtcttcacacataggcaagttacagtccttttaaaaagtatctcatttccctataatggaacctaatagccaactttttcatagaaattgctagaagagtttgatcaactataaatgataaagtgtttataagcatagtcagtgtgacacagaaaccaatcttaaaattgaatttaatgttttatcatatcagattaaatattttctccatgtcttatttttactgcaacaagttagaaagtgggaacactttgattaatgtcttaaaatttgtgggccctcatttggataaaggcagcaatcctaaggactttttttttttttaacataatctgagaatttctctgtagagcagagactttcaaaccttttggctgtaacccacagtaaaaaacgcatttatatcaaaccttagaatatgtttaatgaacaatacttaccattctgatgctttttattgtttcagtttttaaaatatgccagttgcaacccactaaattgatatctaccaatgggttgcaacccttagcttgaaaaaaacaccctcacagaggaactggtatttcttgaataccttctgtttgccaggcacttcaccaggcattttacaagtaaggaaactgggcttcagagaaaataatttgcagaggtttactcaactacaaaggggtgaagccaggaatgttaactaggtctgttgagctacaaaaacttttatgtctctcagactatacagcctctatacaaaattgagatgggggttgggggcaggggctcatgcctgcaatcccagcacttagggaggcagaggccagaggatcacttgagcccaggagtttgagaccagcctgggcaacatagtgagactctgtctgtatgaaaaaaattaagaattagctgggtgtggcatagcacacacctgtggtcccagctacatgggaagctgaagtgggaggatcacttgaactcaggagcagccttggtgacagaacaagaccctctctcaaaaaaatatttaaaaaaaggtgggtcatccattctcctttaccaaacaggctttgaaatgacacattccattcatttgcatctttttaaaaaacttctgattccttactgagtgtccagcagcctcaaagtttttaatggtagctgatgcagacataaacagtgctcaatttggcccttaaactataaaatcaagaaagagtatttcaatcccatccacctgcctgcaagatttcttaatgttcactagttataaccattgtttaaacagtgctttttgtgtaatttaaaaataaactttaatgcttttta

SEQ ID NO: 375662 - DNA, 3289 bp, Homo sapiens
gtgcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaaccgcatgtctatctcaaaccgcagaaaggctttaatactggaaaaaaagaattcaagactacaggcagctcccctctgtaccccaactcatttaaaataggaggaatcactttttgccttacttaacgcttttttctgagcacagggatgggcacctgcaccccagaaggtgtgagctgtctctctgccaggagctaaggttcattaggggattggatggtttatcacttctttctttctgagtttacttttagtaacttttattgatggctacctttcatgtccctgtctaaagagactttctctttcatacgtcttaaatctcatcaatgaaatccagtgaaacagcaccatttcttagtatcattaaataactagaaagtatcaagtattgctctctgctgctttatatcattaacatattaataataccaagaaggaaatactttgaataagtgtcagattctgatccagtattggacacctgtgatattggacacctgtgaggctgggataattacttttgaattacacctcttctctagtttctggaccttgctctgtcactttaacacagggtgatcaaacctgaatgaggatcagaactcacccaggcacatactaaagcaagattcctaaacctcagttccaggggtaattctgacatcacccgtccagcatagtcagctgaaattataaatctaagaaacaaatcaataggccgggcgcagtggctcatgcctgtaatcccagcactttgggaggccgaagcgggcgaatcatgaggtcaggaaatcgagaccatcctggctaacatggtgaaacccagtctctactaaaaatacaaaaaattagccaggcatggtggcgggcacctgtagtcccagctactcaggaggctgaggcaggagaatggcctgaacctaggaggtggagcttgcagtgagccgagatagcgccactgcactccagcctgggcaacagagcgagactctgtctcaa

SEQ ID NO: 375663 - DNA, 363 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctggtgggtgactcaggaaggtgtttagtccaaggcagcctacaaactgtccagttgctgggtgctgccactgccatctgggccttagaatgggatgtcaggacacacctgcagctggcgctctgtcctcggaacctgtaatttaaataag

SEQ ID NO: 375664 - DNA, 811 bp, Homo sapiens
  misc_feature (20)..(20): n is a, c, g, or t
cgggcgcaaatacagtacancgtttgtgggcacgagcatttaaaaattctctgctggtgagcatttcggcacgatgtgaagagcgggtcaggaagatgagcacagcactgctactcctgtgggcacagggacagcatgtctccagccaccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375665 - DNA, 6323 bp, Homo sapiens
  misc_feature (2)..(3): n is a, c, g, or t
  misc_feature (9)..(9): n is a, c, g, or t
  misc_feature (12)..(13): n is a, c, g, or t
gnntcggcncgnncctcgggccgcgagaggcgccgggatcgcgggcgccggctgagccagcggctcttgggaggctgcgtccgcgcgccggcggggcggggcggccgggccctgcgcgtcaggcctgagacctgggaggaagctggagaaaagatgccctctgaatctttgtgtttggctgcccaggctcgcctcgactccaaatggttgaaaacagatatacagagtcattttttacaggtcagaactgtagaaataatgagaaagtgacacttgtacgcatagctgatttggagaaccataataacgatggaggcttctggactgtgattgacgggaaagtgtatgatataaaggacttccagacacagtcgttaacagaaaatagtattcttgctcagtttgcaggggaagacccagtggtagctttggaagctgctttgcagtttgaagacacccgggaatccatgcacgcattttgtgttggccagtatttggagcctgaccaagaaggcgtcaccataccagatctggggagtctctcctcacctctgatagacacagagaggaatctgggcctgcttctcggattacacgcttcctatttagcaatgagcacaccgctgtctcctgtcgagattgaatgtgccaaatggcttcagtcatccatcttctctggaggcctgcagaccagccagatccactacagctacaacgaggagaaagacgaggaccactgcagctccccagggggcacacctgccagcaaatctcgactctgctcccacagacgggccctgggggaccattcccaggcatttctgcaagccattgcagacaacaacattcaggatcacaacgtgaaggactttttgtgtcaaatagaaaggtactgtaggcagtgccatttgaccacaccgatcatgtttccccccgagcatcccgtggaagaggtcggtcgcttgctgttatgttgcctcttaaaacatgaagatttaggtcatgtggcattatctttagttcatgcaggtgcacttgatattgagcaagtaaagcacagaacgttgcctaagtcagtggtggatgtttgtagagttgtctaccaagcaaaatgttcgctcattaagactcatcaagaacagggccgttcttacaaggaggtctgcgctcctgtcatcaaacgtttgagattcctctttaatgaattgagacctgctgtttgtaatgacctctctataatgtctaagtttaaattgttaagttctttgccccattggaggaggatagctcagaagataattcgagaaccaaggaaaaagagagttcctaagaagccagaatctacggatgatgaagaaaaaattggaaacgaagagagtgatttagaagaagcttgcattttgcctcatagtccaataaatgtggacaagagacccattgcaattaaatcacccaaggacaaatggcagccgctgttgagtactgttacagatgttcacaaatacaagtggttgaagcagaatgtgcagggtctttatccgcagtctccactcctcagtacaattgctgaatttgcccttaaagaagagccagtggatgtggaaaagagaaagtgcctactaaaacagttggagagagcagaggttcgcctggaagggatagatacaattttaaaattgtatctggtgagcaagaatttcttacttccatctgtgccgtatgcgatgttttgtggatggcaaagacttattcctgagggaatcgatataggggaacctcttactgattgtttaaaggatgttgatttgatcccgccttttaatcggatgctgctggaagtcacctttggcaagctgtacgcttgggctgttcagaacattcgaaatgttttggtggatgccagtgccaaatttaaagagcttggtatccagccggttcccctgcaaaccatcaccaatgagaacccatcgggaccgagcctggggaccatcccgcaagcccacttcctcctggtgatgctcagcatgctcaccctgcagcacagcgcaaacaaccttgacctcctgctcaattccggcacgctggccctcgctcagacggcactgcgcctgattggccccagttgtgacagcgttgaggaagatatgaatgcttctgctcaaggtgcttctgccacagttttggaagaaacaaggaaggaaacggctcctgtgcagctccctgtttcagggccagaactggctgccatgatgaagattggaacaagggtcatgagaggtgtggactggaaatggggcgatcaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaacaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgtcctggtgaagagcggcgcagtgtcgtcactcagagatgagtgaccatctcccttccctgtgaccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375666 - DNA, 750 bp, Homo sapiens
ctttcttaactcagttgctattttacaaataggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggtatggcagaatgtttatattctctcttccaccaaatattaatgaaatacttattgtggaccacagtgtactggaatttgttattttaaggttcctttgcatatggtaattctgtagagtgagtacagtgagacggaagtgacggtcctacccgctgatgactggctggctttttaaaaaaatcaggatggggtatcggggaagaattagaataactaggcttgtttgcttgtttttccataaagaaacattaaaagaatctcaagaaactagtaagtgtttagttgcgtggcatgtggaattggttagatggagagtgagtgttttaatttgtataccttttattatatttttcattgtggcaaaatatatttaacttaaaattagccacttagtcattttctaagtttataattcagggtattaagtaccttaagtacagtgttgcacaaccatcacaactttctcttaccaaaacttttcaccactccgatcagaaactctgtacccattaagcaatttaactgccctacttccccttaccccaaccctggtaaccttgaatctaactttggtct

SEQ ID NO: 375667 - DNA, 572 bp, Homo sapiens
cgatccctgtaacaccgcaactccaccaaatattaatgaaatacttattgtggaccacagtgtactggaatttgttattttaaggttcctttgcatatggtaattctgtagagtgagtacagtgagacggaagtgacggtcctacccgctgatgactggctggctttttaaaaaaatcaggatggggtatcggggaagaattagaataactaggcttgtttgcttgtttttccataaagaaacattaaaagaatctcaagaaactagtaagtgtttagttgcgtggcatgtggaattggttagatggagagtgagtgttttaatttgtataccttttattatatttttcattgtggcaaaatatatttaacttaaaattagccacttagtcattttctaagtttataattcagggtattaagtaccttaagtacagtgttgcacaaccatcacaactttctcttaccaaaacttttcaccactccgatcagaaactctgtacccattaagcaatttaactgccctacttccccttaccccaaccctggtaaccttgaatctaactttggtct

SEQ ID NO: 375668 - DNA, 540 bp, Homo sapiens
agactcggctgagttcatcaacagctgtgatttcaacaggacgagggccatgtcgtgacccccacgtcccccaagtcaggatggcacgccacccccaggccacctgcagccttacctgccccgagtccgtgaccgccaggcagtgcagggccccgacagccacatgcacgatcttcttccctctcagcccttccaccacctacagtttccacacgtgcacgtcagagccctggcgcaacctgaagtaatccccctttcccctgagaaggaggcccgtggtggagtgttacaatatagttgtggtctgacaatgctatacaagaagacactcattgtctcacatctttcacagccagctcaatgacatcacacacagcacccaaggtcttcgaacttgtattcaaaatcatacaccattaattcaaattaacttattaagtcagctgggaaaaaccttaataccttaatacatgttctacaatatttaagttactgttgtaggttttcatatagactgaaaataagacacattactgcaaa

SEQ ID NO: 375669 - DNA, 537 bp, Homo sapiens
acggtatgacattctgaaaagcggtgacagattaaaaaatttttaattctgcagatgatagtgtcgaaccaagtgggacaaagaaagatctgaatgacaaagagaaaaaagatgaagaagaaactcctgcacctatatatagggccaagtcaattctggacagctgggtatggggcaagcaaccaggtgatcttgcgaattttggcactttggaaaggttgatctgacactccctttctaaataacttgaatggattcttagtatttttttggtaacaattttttaaaaactaattaaaaaatttaaatattgtggtaaaatatacataccatgtaacttaccgttttaaccagttttatgtgtacagttcattggcattaaatatattgacattgttgcccagccatcacgcttgactaattagagacagaatctcactgtgttgcccaggccggtcttatactcctggcttcacgggatcttcctgcctcagactcctgagttgctgagatttcagatgtgagccatcgcacctg

SEQ ID NO: 375670 - DNA, 744 bp, Homo sapiens
aaaacttgaagtatatagaaaatatctgagaagatagtaaccaccacactgatgtaattattgttgacaggtttgtaaagaaaaattaatatagattatacttattatatgtgtaaatctctatcctgcctttaatgtcattttaaaaaatgattattctcagctataaaaaggcttacgggtatgtgtggcatttcaggattaagcccatggttttgatgactttcagaacgtttcatttgttagtcatattggccacactctgacagcttctgtgtcctctccagctccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacaggtgtctttttaaaaagttcttaaatctttataagaagggcagtagaaagtagacaaaggaagtgaataatcagttcataaaaatggacataggtggcttataaatgtacaaaacagacacgtggcctgcccagcaaccaccaactgtgaataaaattgtcatcgtcatcttata

SEQ ID NO: 375671 - DNA, 6306 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375672 - DNA, 5968 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagcaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcaaagaatgaaatctacagcatgtattcatttgcatctggcttctgccacccaacattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375673 - DNA, 4975 bp, Homo sapiens
ctacaagcacatccgatggcccgcggccagtacggatgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375674 - DNA, 3212 bp, Homo sapiens
tagacacacgagcatatttcaccttcgctaccataatcatcgctatccctactgtaaatatatggtgtgacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375675 - DNA, 4071 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375676 - DNA, 4331 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttgcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375677 - DNA, 3753 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaaggagaagcattagggtgtccgactacgtgggtttcatagccgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375678 - DNA, 2571 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgccctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagtgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375679 - DNA, 6327 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaaataattacacccattatttct

SEQ ID NO: 375680 - DNA, 6453 bp, Homo sapiens
  misc_feature (6343)..(6343): n is a, c, g, or t
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaaaaaaaaaaaaaaaaaaaaaaaaactcgagggggggcngcccggtacccacatattccgcccttattagtggagtcggtatttacaaattcaactgggcccgtcgttttttacaaacgttcgtggacttggggaaaaaacctcttggc

SEQ ID NO: 375681 - DNA, 6342 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaaaaaaaaaaataaagtcgacgggccgcgaatttagta

SEQ ID NO: 375682 - DNA, 3754 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375683 - DNA, 6205 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatacagtccttttatctgtgtattaattggttt

SEQ ID NO: 375684 - DNA, 2683 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgagtaattgtcttaagctggagcctcgatccgtttttcactcagcaaatatttgggtatgtcctatatgccaaacatcagtggacagaggcccctgccctcagggagcctgccttctggtgctggaagacatacctgaccagtgagctcatggtacgctagaaggtgctgtgtaccctggaatgagagagagcagactacagtaaaggggtgggagtgagggcacagtccagggat

SEQ ID NO: 375685 - DNA, 2541 bp, Homo sapiens
  misc_feature (2037)..(2037): n is a, c, g, or t
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgaggaaagaatgtccagatgttgtttttggagaagaagaactacaaagttagagcaaatactcttatttataagaagaatgaactcagtgtgtgagaaggagaatacaaatgcaacagcctcaaattagcagtggatgcctnctgggcttctgcaaccgctttccacgggttccaccagatggctagctggtaatgacccagacacctctgagtaaactcccagaaagcctgacaaatatgttgcaaacttagccatatgtagagtggctacaccacatttgcaacgctctcttaacagcatgaccttctttaatagtgatcacttccatttttaggccctttatgcattacttttgtcattttatattgcttctttttttctgatccttgcaaaaaccctgccaagaaagcaagaaaatatgtttccccctcaggacctggacaacatcagatagaatgtgtcacataaatatgtattcataatgaaagttttataggtattaaaaatgaaagctcaaaatggctaggtgatattcctcaattcatatgaacatagatctcttaccttttttcttgatattatattgaatatgtaaagatatttgaaatagtttatatatgagtaattaaaccagctcatctttt

SEQ ID NO: 375686 - DNA, 1929 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacaggtgtctttttaaaaagttcttaaatctttataagaagggcagtagaaagtagacaaaggaagtgaataatcagttcataaaaatggacataggtggcttataaatgtacaaaacagacacgtggcctgcccagcaaccaccaactgtgaataaaattgtcatcgtcatcttata

SEQ ID NO: 375687 - DNA, 1612 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccagtaggtgaacttgtgcttagttactgcatgataagggaaattgactttacactagaaccgagcaccaacatcagcaccaactcctacaggatggggaaagaaggaaaatacgacctcaagctggcagagctgccagcccc

SEQ ID NO: 375688 - DNA, 436 bp, Homo sapiens
tgagatggagtctcgctctgtcacccaggctggagtgcagtggcatgatctcagcacactgcaagctctgcctcccaggttcacaccattctcctgcctcagcctcccgagtagctgggaatacaggcgcctgccatcatgctcagctaattttttgtatttttagtagagacgaggtttcaccgtgttagccaggatggtgtcgatatcctgacctcctgatccacccgccatggcttcccaaagtgctgggattacaggcatgagccaccacgcccggccaatatattggtttctttatgaaaattatactggatctgttacaggtatgattgatgtattttatttttaagttgtcaagcattcagttaatcatgtgtgttgtaacttttcggggagggacatttgcagaggctaacggtatgacattctgaaa

SEQ ID NO: 375689 - DNA, 452 bp, Homo sapiens
ccacctcagtgctctgtttatctgaggactttgacataggaatacttatgtgctctttggttaacacagcacagactttgtttcatgtattatttggagggttttgaggtgagaacctgattgtgttaacatgctagcgaggcttcagaagcattagtgattgcaagtgcgtcagaagctgtggcatgtttaagatttgtgaagactcactgggtttccctgaagttacttccagctgttcctgttgcaggactttttgtgtcaaatagaaaggtactgtaggcagtgccatttgaccacaccgatcatgtttccccccgagcatcccgtggaagaggtcggtcgcttgctgttatgttgcctcttaaaacatgaagatttaggtaaggagctcaatatctttgtactttagctacactgcagattcctcgactaacctgtggtacgtattc

SEQ ID NO: 375690 - DNA, 603 bp, Homo sapiens
gttttagatttcaaggccagcttgagatgctgtgctgggttcccacagaggtggttctgcctttctccaggggtcctaggcttgtagagtggtttggtcatgttagtaatctgtgtggattcaacttacctatggtatcataaatgtatacatgcacagtcaatgttgtgtacatgtatacagcagatttagagatttatacagtttatatgctgcataaatatatagacgtatagtataactgtatcatcaacattgtcatttgatgggtcaaatgagtcaataccaaaatataaagcttgggtaaaaaactgtgttactttagtttttcccaccatttctgaatttttgtttacttttcctttctagcttttgtctggtcctctgagccccagtgagagtttcctgaggtacctcacccttccacaagacaacaggcttgccattgatctgcaacaaacggcggttgttgtcatggcccatttagaccgtctggctacaccctgtagatgcctcctctgtgtagctctccgacgtctcataaggtgtgtgcaagaaccgtgttctccatgtgttttgtagctagtaccacttgtaggttct

SEQ ID NO: 375691 - DNA, 584 bp, Homo sapiens
ctgtaacagttagaagtctggcagtgtcccaagtcaaattctttatctttatttgaaagggaacctcttactgattgtttaaaggatgttgatttgatcccgccttttaatcggatgctgctggaagtcacctttggcaagctgtacgcttgggctgttcagaacattcgaaatgttttggtggatgccagtgccaaatttaaagagcttggtgagtcaataattgtatcaatgttattttatagtttgcctttaattatatgttgtggaaacttgcaaatgccaatttttgcttttgagaagactttaataagtttgtactttgtacttgtataatctatgctgctgtcagctttctcagattttaaacaaaactttaaaatttagcaggagacacaatgttgaagtactctagtataacatttttacattttgacatttttatgtgtatcaccacatatcctaaagtgtctgtgtcctatattgatatttatttcctggatagtttgagcatctacagagagttgattggattggttttgtggaggaaaagtgagacataacttttatatttgaaatggaag

SEQ ID NO: 375692 - DNA, 466 bp, Homo sapiens
catgtctattttccctcccgccgcttctccaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcaggtaatgtgctgccaggcaaaaccagttccctgagagaggcctccatgtactgaagttccctgccctcagagtcaggggcctttattccgtaacgagtgcagaaagggtctagaagtgacagggtagattttctggaggcaaggggcagaggtccttgataattggtaagttgctaaccttcagtttacctgcttttctcttaagtggtaaatcctgcaactacttactcatctgcttcacagaatttgtagtgtaattgtc

SEQ ID NO: 375693 - DNA, 6058 bp, Homo sapiens
  misc_feature (2)..(3): n is a, c, g, or t
  misc_feature (9)..(9): n is a, c, g, or t
  misc_feature (12)..(13): n is a, c, g, or t
gnntcggcncgnncctcgggccgcgagaggcgccgggatcgcgggcgccggctgagccagcggctcttgggaggctgcgtccgcgcgccggcggggcggggcggccgggccctgcgcgtcaggcctgagacctgggaggaagctggagaaaagatgccctctgaatctttgtgtttggctgcccaggctcgcctcgactccaaatggttgaaaacagatatacagcttgcattcacaagagatgggctctgtggtctgtggaatgaaatggttaaagatggagaaattgtatacactggaacagaatcaacccagaacggatagctccctcctggaaaagcttttgtctggtcctctgagccccagtgagagtttcctgaggtacctcacccttccacaagacaacaggcttgccattgatctgcaacaaacggcggttgttgtcatggcccatttagaccgtctggctacaccctgtagatgcctcctctgtgtagctctccgacgtctcataagagtcattttttacaggtcagaactgtagaaataatgagaaagtgacacttgtacgcatagctgatttggagaaccataataacgatggaggcttctggactgtgattgacgggaaagtgtatgatataaaggacttccagacacagtcgttaacagaaaatagtattcttgctcagtttgcaggggaagacccagtggtagctttggaagctgctttgcagtttgaagacacccgggaatccatgcacgcattttgtgttggccagtatttggagcctgaccaagaaggcgtcaccataccagatctggggagtctctcctcacctctgatagacacagagaggaatctgggcctgcttctcggattacacgcttcctatttagcaatgagcacaccgctgtctcctgtcgagattgaatgtgccaaatggcttcagtcatccatcttctctggaggcctgcagaccagccagatccactacagctacaacgaggagaaagacgaggaccactgcagctccccagggggcacacctgccagcaaatctcgactctgctcccacagacgggccctgggggaccattcccaggcatttctgcaagccattgcagacaacaacattcaggatcacaacgtgaaggactttttgtgtcaaatagaaaggtactgtaggcagtgccatttgaccacaccgatcatgtttccccccgagcatcccgtggaagaggtcggtcgcttgctgttatgttgcctcttaaaacatgaagatttaggtcatgtggcattatctttagttcatgcaggtgcacttgatattgagcaagtaaagcacagaacgttgcctaagtcagtggtggatgtttgtagagttgtctaccaagcaaaatgttcgctcattaagactcatcaagaacagggccgttcttacaaggaggtctgcgctcctgtcatcaaacgtttgagattcctctttaatgaattgagacctgctgtttgtaatgacctctctataatgtctaagtttaaattgttaagttctttgccccattggaggaggatagctcagaagataattcgagaaccaaggaaaaagagagttcctaagaagccagaatctacggatgatgaagaaaaaattggaaacgaagagagtgatttagaagaagcttgcattttgcctcatagtccaataaatgtggacaagagacccattgcaattaaatcacccaaggacaaatggcagccgctgttgagtactgttacagatgttcacaaatacaagtggttgaagcagaatgtgcagggtctttatccgcagtctccactcctcagtacaattgctgaatttgcccttaaagaagagccagtggatgtggaaaagagaaagtgcctactaaaacagttggagagagcagaggttcgcctggaagggatagatacaattttaaaattgtatctggtgagcaagaatttcttacttccatctgtgccgtatgcgatgttttgtggatggcaaagacttattcctgagggaatcgatataggggaacctcttactgattgtttaaaggatgttgatttgatcccgccttttaatcggatgctgctggaagtcacctttggcaagctgtacgcttgggctgttcagaacattcgaaatgttttggtggatgccagtgccaaatttaaagagcttggtatccagccggttcccctgcaaaccatcaccaatgagaacccatcgggaccgagcctggggaccatcccgcaagcccacttcctcctggtgatgctcagcatgctcaccctgcagcacagcgcaaacaaccttgacctcctgctcaattccggcacgctggccctcgctcagacggcactgcgcctgattggccccagttgtgacagcgttgaggaagatatgaatgcttctgctcaaggtgcttctgccacagttttggaagaaacaaggaaggaaacggctcctgtgcagctccctgtttcagggccagaactggctgccatgatgaagattggaacaagggtcatgagaggtgtggactggaaatggggcgatcaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375694 - DNA, 6248 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375695 - DNA, 6360 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcaaagaatgaaatctacagcatgtattcatttgcatctggcttctgccacccaacattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375696 - DNA, 6252 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375697 - DNA, 3808 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375698 - DNA, 6251 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagccgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375699 - DNA, 6439 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaaaaaaaaaaactcgagattttttttttttttttgttaaaccactaaagtttattactcatacaaataaaaattcacatttatacagattggtttttaaaaaagggttacttattatttcgggaacatttctgaa

SEQ ID NO: 375700 - DNA, 6725 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaaaaaaaaaaaaaaaaaaaaaaaaaaaaaaaaaaaaaaaaaaaaaaaaaaaaaaaaggagcgaggaggaggagcacgaaaaaaaaaaaaaaacgagggggggcgcgcccgccgaagaggccccccgccggggccgccgagccaagggcgccccccccagggggggcgtaaagggcccgcgggggcggtacaacaccagcggccgcggggcacaaccaccacggcgcggtccctctggcgagaagaaccccccctcctcgcggccacggcgggacaacacaccgcgaccccaacactccgcgagaacaaattcagcgccccacagcacaccacaaaaaccacccacccgctacaggcgtcacccaacgccatcatccgcgcggcaaacgtcgcccccgcgcctccgacacacctctacacga

SEQ ID NO: 375701 - DNA, 6252 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcatacttgatttttctatttgttatttcataaaccaattaatacacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaa

SEQ ID NO: 375702 - DNA, 6119 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagggtaagtggcctaaaatttttctagtattttcaaaatgacccagttacaataggaaatttcttcttgtactattgtcactaatcccgactcaatatcctttaaaggacaaagatgcatgcataagtaaaaatatgacaggtcacaatcacgccggggtggtcctggggcgaggcccaagttccctgcacgcgtcggcacaagcacgcacactgtgacggggaggacgtttacgtaccatgtccacaccactccagacttggtgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggaagggaagggagagaagaaaggaaagataaagaaagcccaacctccttccaaaatgtcatgagaatcttgagcacatatggtccttggcatgaccacatgacctgcagagcccctgttatagaactcatttttatattttccttagtataacagttaatataatatgtcatttttgttaatagtgtctttttgtcattttactttttaaaagattttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtcattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtttccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattccaaattcatgttgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatgacacgcccataccccccatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagagggggaaagcattggccccaggccaaaatcataaacgctttcaattaactaataataattgctggcatgttgccattaaatattcttgtctcattatctctggttgctttatcaaacccataggtcactgaagcccacttttgagacaaagactatttctcccccaaaagtcaagggaaatataaaaaatgaaattagtgattaagaatagaagtcaattaatacaatcattttgtcttaattatttaaagtccagttttttccctccagcaaacctgaaaatacactatcctccagctatcagaattatattgagatctactcacatttatgatgatgttcagagattctcattgggaaggaaaaggcacacgctgcggcggtcttgcatgactctgttgttgtggaaattcaatttgttcattgtgttttgggctctctgggtggtcagggctgggctctgggtccttggcaattcctcaggttcccagcactccaaagccaagctcacctcctcatcacacaccctacaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagcgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtaccacatgggagataaagggttttgaacatgaaatgacaaaaacaacagcaagaagaaaattcttgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctttctacaacatttatcctggttgttaagccctccttacaacattcttctctctttgtttttatagctccatctctcctgcttctttaacttgataatgcaggagagatggagctaaaaaaaaaa

SEQ ID NO: 375703 - DNA, 3463 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagaacccatggatacggagggctagctgtatatgtttattgctgtggaaacatgaaaacaatgatggagcagtggtatcacctgaccttggggacatgtctcctgaagggccgcagccccccatgatcctcttgcagcagctgctggcctcggccacccagccgtctcctgtgaaggccatatttgataaacaggaacttgagactgctgcactggccgttgtggagtccactcacccttcgagcccaggatttgaagactgcagctccagtgaggccaccacgcctgtcaacgtgcagcacatccgccctgccagagtgaagaggcgcaagcagtcacccgttcccgctctgccgatcgtggtgcagctcatggagatgggatttcccagaaggaacatcgagtttgccctgaagtctctcactggtgcttccgggaatgcgtccggcttgcctggtgtggaagccttggtcgggtggctgctggaccactccgacatacaggtcacggagctctcagatgcagacacggtgtccgacgagtattctgacgaggaggtggtggaggacatggatgatgccgcctactccatgtctactggtgctgttgtgacggagagccagacgtacaaaaaccgagctggtttcttgggtaatgatgattatgctgtatatgtgagagagaatattcaggtgggaatgatggttagatgctgccgaacatacgaagaagtgtgcgaaggtgatgtgatgttggcaaagtcatcaagctggacagagatggattgcatgatctcaatgtgcagtgtgactggcagcagaaagggggcatctactggtttaggtacattcatgtggaacttataggctatcctccaccaagaagttcttctcacatcaagattggtgataaagtgcgggtcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggtatggcagaatgtttatattctctcttccaccaaatattaatgaaatacttattgtggaccacagtgtactggaatttgttattttaaggttcctttgcatatggtaattctgtagagtgagtacagtgagacggaagtgacggtcctacccgctgatgactggctggctttttaaaaaaatcaggatggggtatcggggaagaattagaataactaggcttgtttgcttgtttttccataaagaaacattaaaagaatctcaagaaactagtaagtgtttagttgcgtggcatgtggaattggttagatggagagtgagtgttttaatttgtataccttttattatatttttcattgtggcaaaatatatttaacttaaaattagccacttagtcattttctaagtttataattcagggtattaagtaccttaagtacagtgttgcacaaccatcacaactttctcttaccaaaacttttcaccactccgatcagaaactctgtacccattaagcaatttaactgccctacttccccttaccccaaccctggtaaccttgaatctaactttggtct

SEQ ID NO: 375704 - DNA, 2526 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggcgccagcagttgaagctatacatcctgaaagcaggtcgggcgctgttctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgaggtacagccatgcagccttgacagtttttaatccacagcactaaattgtgaacactttttttctagatgtatattttcttaaggatctattctgaatgttaaatgatagtacgcaaataattctaatgattcattggggtttaaccatgtttgtgcatagtctgcagaacattataatactaaagactgagagggttgaagtttaaccttattttgggtttgtgtaaattgtgaaaaaatattaactagatgcagcatgggttaaacgctcacatcttcatgaagggatctttttccaggaagtagaattattcaaagaggctcgtcaggactctggcagccgtttgtctgtttcattcactcaggagcctcttgggggtgctctggtgccgccagcctctccgctctctccatgctgtggagcaggtgagggcagcagcgaggcacagggtcagggctacgggacgttcgcatagaggaggcgacgtgattgagtgtaagagggatgggagctttcatggctggcaacatagaggattagagatgttcattccaaaatctttcttgctgtgtaatacattaaaaatctggacaaatatcagagacaaaaataaaactatcagtactca

SEQ ID NO: 375705 - DNA, 1945 bp, Homo sapiens
ggcacgagccaaactcctacaggatgggcctcctccaggcctaggccgagtgattggtgagctgggagaggacgggtggataagagtccagtgggacacaggcagcaccaactcctacaggatggggaaagaaggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgttagtggaaagcggaacgacggacaagacatcaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgaaagggtgagggacatgaaatgcctcatggagaagctgtttgacttcttggggagcttgctcactatgtgctcctctgacgtgccgttactcagaggtgggtggccgtctcccttccctgtaccctggtgaagagcggtgcagtgccgtcactcagaggtgggtggccgtctcccttccctgtgtcctggtgaagagcggtgcagtgccgtcactcagaggtgggtggccgtctcccttccctgtaccctggtgaagagcggtgcagtgccgtcactcagaggtgggtggccgtctcccttccctgtgtcctggtgaagagccgtgtagtgccgtcactcagaggtgagtggccgtctcccttccctgtgccctggtgaagagtggtgcagcagcttctcccctggtttcctcctcagagtccacgctgaggcggcgcagggtgtgcccgcaggcctcgctgactgccacccacagcagcacactggcggaggaggtggtggcactgctgcacacgctgcactccctgactcggtggaatgggctcatcaacaagtacatcaactcccagctccgctccatcacccacagctttgcgggaaggccttccaaaggggcccagttagatgactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcgcgtttgcccattgaatcagctgaaaccagtaggtgaacttgtgcttagttactgcatgataagggaaattgactttacactagaaccgagcaccaacatcagcacttgaaagaacttgattctggtacttgaagtttgccttccaggaagctgtgcgagcttgtgcttctgtggtaagcagggcctgtctcacagggcacttaaagcagtggttcgtgtgtatttcagcctcagagacacgaagagggctttagcaacctagaaggtaccgtgcatctatgaggtagttctaattattttaaaatgtgaatttatgaagtttactttttattcaacaactcaagttttaaaaaaacaaacatgtttaaacacctttaaaaaaacagcctttcttcatgtagaaaatgcttagtagttttgagtgacgtgacttaatgtagcagctactgtcatcttaatctgtgaatcaaggatgcacagggagaaggagccatttacatt

SEQ ID NO: 375706 - DNA, 553 bp, Homo sapiens
gagtactgttacagatgttcacaaatacaagtggttgaagcagaatgtgcagggtctttatccgcagtctccactcctcagtacaattgctgaatttgcccttaaagaagagccagtggatgtggaaaagagaaagtgcctactaaaacaggtaacatttgatgagaaatgcttctctgcattgggtaatatacataacacttaactgtatgcattgatattttgcagttggagagagcagaggttcgcctggaagggatagatacaattttaaaattgtatctggtgagcaagaatttcttacttccatctgtgccgtatgcgatgttttgtggatggcaaagacttattcctgagggaatcgatataggtaaaacgttagcatatttttttcttaattaaggaagctgtggcaacagaatgtttttctgtaacagttagaagtctggcagtgtcccaagtcaaattctttatctttatttgaaagggaacctcttactgattgtttaaaggatgttgatttgatcccgccttttaatcggatgctgctgga

SEQ ID NO: 375707 - DNA, 1080 bp, Homo sapiens
agcggaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtggatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagagcttatgtcagggccagatggaaatgacagtgcctactccaagagttccccatgctgggaaagagaacacctgtgaacagggcctccatgcacagccaactggggtgagaattctatttggtgcacgtgctattgtgtccggaattggtgggttcttggtctcactgacttcaagaatgaagccgcggaccctcgcggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgaggtaaagctt

SEQ ID NO: 375708 - DNA, 2014 bp, Homo sapiens
agcggaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggctgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttca

SEQ ID NO: 375709 - DNA, 2230 bp, Homo sapiens
agcggaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggctgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttcaaaaacacacaaactcaccaaaattactaatcaaaaaaatcaacacacaacattatacaaatacaaaagtcagcacacacaaagcactaacacaaatagcaacaaccagagatcagatataacacactgtataccaaaagaccaaccatgaaagaaagagacacacaatgccaaacagagatcgccaaagagcacaagaaacaacacacacaacaat

SEQ ID NO: 375710 - DNA, 1614 bp, Homo sapiens
gggatgtggtaaggctctggcctggagatgtgatttgcagagactgtcggcgtgatctctctcattgtctctgtgttgcagcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggctgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttca

SEQ ID NO: 375711 - DNA, 1951 bp, Homo sapiens
agcggaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggctgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttca

SEQ ID NO: 375712 - DNA, 1758 bp, Homo sapiens
agcggaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagaggttgcagaacttgaagctaatttaccttgtacatgtaaagtgcattttcctgatccaaacaagcttcattgttttcagctaacagtaaccccagcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggctgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttca

SEQ ID NO: 375713 - DNA, 1473 bp, Homo sapiens
agcggaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggca

SEQ ID NO: 375714 - DNA, 883 bp, Homo sapiens
agcggaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggtgagaattctatttggtgcacgtgctattgtgtccggaattggtgggttcttggtctcactgacttcaagaatgaagccgcggaccctcgcggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgaggtaaagctt

SEQ ID NO: 375715 - DNA, 2143 bp, Homo sapiens
agcggaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttacagggtctctctttgttgcccaagttggagtacagtggcatgagtgtggctcactgcagtctcaacctcctgggctcaagtgatcttcccacctcagtctcctgagcagctgagacctcagacctcaggtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggctgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttca

SEQ ID NO: 375716 - DNA, 1812 bp, Homo sapiens
agcggaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagaggttgcagaacttgaagctaatttaccttgtacatgtaaagtgcattttcctgatccaaacaagcttcattgttttcagctaacagtaaccccagcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggctgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttca

SEQ ID NO: 375717 - DNA, 1960 bp, Homo sapiens
agcggaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggctgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttca

SEQ ID NO: 375718 - DNA, 1956 bp, Homo sapiens
agcggaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggctgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttca

SEQ ID NO: 375719 - DNA, 6500 bp, Homo sapiens
ctttctccttccctcttgcctccagtgactgtctccaggatttctctcttcctatttcaggaggactctcacaggctcccacagcctgtgttaagctgaggtttcccctagatctcgtatatccccaacacatacctccacgcacacacatccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggggaacacttaagaatctgtcctcaggaatatacatgctgcaccacagaaatggaagacaagttaagccaacaaagcaaactcgaatttgaaaaccttgtggaagagacaagccattttgtgcgcaccacttttgtgtccaggcataagaaatttgacgaatttttccgagagctcctggagaatgcagaaaagtcactaaatgatatgtttgtacggacctatggcatgctgtacatgcagaattcagaagtcttccaggacctcttcacagagctgaaaaggtactacactgggggtaatgtgaatctggaggaaatgctcaatgacttttgggctcggctcctggaacggatgtttcagctgataaaccctcagtatcacttcagtgaagactacctggaatgtgtgagcaaatacactgaccagctcaagccatttggagacgtgccccggaaactgaagattcaggttacccgcgccttcattgctgccaggacctttgtccaggggctgactgtgggcagagaagttgcaaaccgagtttccaaggtcagcccaaccccagggtgtatccgtgccctcatgaagatgctgtactgcccatactgtcgggggcttcccactgtgaggccctgcaacaactactgtctcaacgtcatgaagggctgcttggcaaatcaggctgacctcgacacagagtggaatctgtttatagatgcaatgctcttggtggcagagcgactggaggggccattcaacattgagtcggtcatggacccgatagatgtcaagatttctgaagccattatgaacatgcaagaaaacagcatgcaggtgtctgcaaaggtctttcagggatgtggtcagcccaaacctgctccagccctcagatctgcccgctcagctcctgaaaattttaatacacgtttcaggccctacaatcctgaggaaagaccaacaactgctgcaggcacaagcttggaccggctggtcacagacataaaagagaaattgaagctctctaaaaaggtctggtcagcattaccctacactatctgcaaggacgagagcgtgacagcgggcacgtccaacgaggaggaatgctggaacgggcacagcaaagccagatacttgcctgagatcatgaatgatgggctcaccaaccagatcaacaatcccgaggtggatgtggacatcactcggcctgacactttcatcagacagcagattatggctctccgtgtgatgaccaacaaactaaaaaacgcctacaatggcaatgatgtcaatttccaggacacaagtgatgaatccagtggctcagggagtggcagtgggtgcatggatgacgtgtgtcccacggagtttgagtttgtcaccacagaggcccccgcagtggatcccgaccggagagaggtggactcttctgcagcccagcgtggccactccctgctctcctggtctctcacctgcattgtcctggcactgcagagactgtgcagataatcttgggtttttggtcagatgaaactgcattttagctatctgaatggccaactcacttcttttcttacactcttggacaatggaccatgccacaaaaacttaccgttttctatgagaagagagcagtaatgcaatctgcctccctttttgttttcccaaagagtaccgggtgccagactgaactgcttcctctttccttcagctatctgtggggaccttgtttattctagagagaattcttactcaaatttttcgtaccaggagattttcttaccttcatttgcttttatgctgcagaagtaaaggaatctcacgttgtgagggtttttttttttctcatttaaaataaaaaaggaagaaagaaaataattttccttgtaaaatcgggccaaaccccaagacagctacattttcaacaaaaaagcaaacagagaaaaataaatgaactttaacactgtaagttcagcattgacagcacttccagtgtaagcttttttgtgacaaatccgggtttaaaaatgcttatggggagaaagcttaaagtttgttctaaatgtagtgaaaatgcactgttgtcttggaggtatcatcttgcactctaaccaaacaacaccaaattaatctggaggtactgatactaaatttggaatcccgtctttaatatgagaacacaaattactacaactcagtacctctgtcttactctgcccaatttcaatttagtaatggcaccattattcttaattcccttaatgtctgtccgctgtatccaattggcacagattttccccttcatcttcaattactagtagctacccccatcaattcaccttcctcaagagtctcaattgaaaataatctttgatgatacaatctctgcttttgccacaggtttgacattaactagacgtttctgcccctgtgctcattaccctcccaaaacaatagtttttttaatgaattgaaacacaattagatccattcctgagttttcatttttaactatttactttgtgtcagttggtttctgcatcacaagggcattctcttacaaaacaactcacaacagaaaaaaaaagtcaagacaaaaaatatatatatatagtattgacatggagatttctttcacttttttagtcttagtatgatcatctatttttatatctatgtatatataaatcacagattttaacttcttaattccaagctcagggttgacacacctttgtaagaaaatgttttgtcaaccagctcttcttgttttgtgctgctcaaagaagggattcctcagtgatcggtgagcaccaagaatcaagaaagagaactttttatgtatctaactgtccatttattaaaaatttgccagggcacacccttctgcatgagtgtgcttcagcctgggtgctccagactacaccaaactcatgggatgagccattggtgtgcagggctttaccggtgatggaaactgtatgtgtaaagaatgttattcatgaaaaaccattgctttcatgtaaaacaccttcggcctaggattcctgcctggcacttggatacattacctaactcaataggccagtttagagccacagcctaacctgttcaccaagtaggccaaagccaggcctttcgctccccctgacagagagaagcaaaataaacccaactgggggctttatgaatacagttggctatccatatgtttcttagtttttatgatgcatctggagtagggaaaagtaatgtttcaagacaccatagtaggccagttacattttaattaactcatcgacagtattgacacgtaaatggtatttttcaatctgttctcatcaaaattaaaattagttattgatttagtcatcacatttaagtagaacacatgtggcacaatagtattaagtatatttgagcacttttgcaagacagaaagtatttacaagcatctattgctactttatgcctaatgaaatataaaatgtaggatgatgagagactttgtggcattctttcatttaaacctttatgaaattaaccatctagttcatcattacatactcctagaaaaccatccatttcactgcccacattttggcttcctaccacaaattccacataagacttctctatgaaggaccagtcatttacattgctcatttcattctgtgttcagaagtcagtattgtctttctccaataattaaggtgcaatacaaattaaatcaaccttgattttccagactatttgaataataacttgcttttatggctttaaactccaggtctttcctttttaaaatatttctgcattctcttttatgaactagatcaggatgccttgtttttcctgtgctttcacccccaaaaggttttgtgcatgtgtatgaatacacataatattagtgaatgtgaacccatgttctatacgcactaaacacacagttaatatataaacgcctgcttcatttgtttcaacaccttcattatcaatatgattcatattgatgagatatagtgatgcataatgagccaggcagagagctgaaatgatatcagttaatgatgtcacagtgttagcaccctgcatggatgtggtcaaaatatcattcaagttgtacttcctagtttttatcatcatactactatgtcatatgattttcagactaatttaacatgagaaatgttttggccctaaaggatttcacttaacctagttaccctatttcagtaagtattttggaattcaaccctcgaattattttttctcatttcagcatagtgataggggatgcaatgaggcttcattattttttatgacctgcccctcatttgctctgatgttccctaaattctgtaatcatatcataacttttgttatgaatagagaggaatgggctcactgaaacctgacactagaaattggtgggtgatgctcataactgcaaacacttagcttattgaagtgcctctatttacatgttctttagttataatatgtatttttctaacagaaatacacgtctgtaattggtatatattatactttgtatgtgtcacaacaaaagctaaacagaggctaaagtctttagcagagaagaatgaattacaaatttaccaataagagctctgtttatggttctgtattgaaggacaaccatgacaaccttctgtcattttcacgaaggccaagttggtactttgattatagccatcgtagaacattagcactagaaatctgtctcccttacaatgacttacctagctagcatcaagtaacttgtatcacctgctttaaatgtaagggatagaaaatactattttgtctacactgaaaaacattattattcattgataagtagtaataattataaaagtaacattctttaaagcaaacacattgaaaatattattacaggcagaaccctgatttttaatttatattccctgctgcagacattagccttctttaattcttttgccattacatacatgtttcggctacagactgaacacgaactaaagtccctaaggaggaaaaaaccttaacatattcctgagatgtgattcttttattacttctttttgcaaagctaattatcaaatgatttgattaaacctagacgcattaggaaatgcaagttttacctaaaacttgcagaaatttaaacacatttccatttacttactaacgaacagacctgatttttatttaaaaacacaatttagctttgccaacagaagagtaaaggaaaccataacttataaatttgtaatgtgttcctccttgttggagacattagccagtgtttagttttagaccaacttatacaaacagagtattgatttgtacacattctggagacttgctatatcatggtttgctatggcacagactcagcttagcatggggacattttgaacttcattcaaagttgagtagttactggaacctttgacattgccttgtaatgaggtacttccaaaaaaagacccctaacaatggcataatagtgaggtctctctgtgcatatacataatatatatgcaggataaatgtgtgcaccaatcaaatctaaaattttatgtgactgtcaaatgaatattatttgggttaagatttttcatttctgatttggatagaaaattgctattaatcttgtattaaaatagtttttaaaaatcta

SEQ ID NO: 375720 - DNA, 6761 bp, Homo sapiens
ctttctccttccctcttgcctccagtgactgtctccaggatttctctcttcctatttcaggaggactctcacaggctcccacagcctgtgttaagctgaggtttcccctagatctcgtatatccccaacacatacctccacgcacacacatccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggggaacacttaagaatctgtcctcaggaatatacatgctgcaccacagaaatggaagacaagttaagccaacaaagcaaactcgaatttgaaaaccttgtggaagagacaagccattttgtgcgcaccacttttgtgtccaggcataagaaatttgacgaatttttccgagagctcctggagaatgcagaaaagtcactaaatgatatgtttgtacggacctatggcatgctgtacatgcagaattcagaagtcttccaggacctcttcacagagctgaaaaggtactacactgggggtaatgtgaatctggaggaaatgctcaatgacttttgggctcggctcctggaacggatgtttcagctgataaaccctcagtatcacttcagtgaagactacctggaatgtgtgagcaaatacactgaccagctcaagccatttggagacgtgccccggaaactgaagattcaggttacccgcgccttcattgctgccaggacctttgtccaggggctgactgtgggcagagaagttgcaaaccgagtttccaaggtcagcccaaccccagggtgtatccgtgccctcatgaagatgctgtactgcccatactgtcgggggcttcccactgtgaggccctgcaacaactactgtctcaacgtcatgaagggctgcttggcaaatcaggctgacctcgacacagagtggaatctgtttatagatgcaatgctcttggtggcagagcgactggaggggccattcaacattgagtcggtcatggacccgatagatgtcaagatttctgaagccattatgaacatgcaagaaaacagcatgcaggtgtctgcaaaggtctttcagggatgtggtcagcccaaacctgctccagccctcagatctgcccgctcagctcctgaaaattttaatacacgtttcaggccctacaatcctgaggaaagaccaacaactgctgcaggcacaagcttggaccggctggtcacagacataaaagagaaattgaagctctctaaaaaggtctggtcagcattaccctacactatctgcaaggacgagagcgtgacagcgggcacgtccaacgaggaggaatgctggaacgggcacagcaaagccagatacttgcctgagatcatgaatgatgggctcaccaaccagatcaacaatcccgaggtggatgtggacatcactcggcctgacactttcatcagacagcagattatggctctccgtgtgatgaccaacaaactaaaaaacgcctacaatggcaatgatgtcaatttccaggacacaagtgatgaatccagtggctcagggagtggcagtgggtgcatggatgacgtgtgtcccacggagtttgagtttgtcaccacagaggcccccgcagtggatcccgaccggagagaggtggactcttctgcagcccagcgtggccactccctgctctcctggtctctcacctgcattgtcctggcactgcagagactgtgcagataatcttgggtttttggtcagatgaaactgcattttagctatctgaatggccaactcacttcttttcttacactcttggacaatggaccatgccacaaaaacttaccgttttctatgagaagagagcagtaatgcaatctgcctccctttttgttttcccaaagagtaccgggtgccagactgaactgcttcctctttccttcagctatctgtggggaccttgtttattctagagagaattcttactcaaatttttcgtaccaggagattttcttaccttcatttgcttttatgctgcagaagtaaaggaatctcacgttgtgagggtttttttttttctcatttaaaataaaaaaggaagaaagaaaataattttccttgtaaaatcgggccaaaccccaagacagctacattttcaacaaaaaagcaaacagagaaaaataaatgaactttaacactgtaagttcagcattgacagcacttccagtgtaagcttttttgtgacaaatccgggtttaaaaatgcttatggggagaaagcttaaagtttgttctaaatgtagtgaaaatgcactgttgtcttggaggtatcatcttgcactctaaccaaacaacaccaaattaatctggaggtactgatactaaatttggaatcccgtctttaatatgagaacacaaattactacaactcagtacctctgtcttactctgcccaatttcaatttagtaatggcaccattattcttaattcccttaatgtctgtccgctgtatccaattggcacagattttccccttcatcttcaattactagtagctacccccatcaattcaccttcctcaagagtctcaattgaaaataatctttgatgatacaatctctgcttttgccacaggtttgacattaactagacgtttctgcccctgtgctcattaccctcccaaaacaatagtttttttaatgaattgaaacacaattagatccattcctgagttttcatttttaactatttactttgtgtcagttggtttctgcatcacaagggcattctcttacaaaacaactcacaacagaaaaaaaaagtcaagacaaaaaatatatatatatagtattgacatggagatttctttcacttttttagtcttagtatgatcatctatttttatatctatgtatatataaatcacagattttaacttcttaattccaagctcagggttgacacacctttgtaagaaaatgttttgtcaaccagctcttcttgttttgtgctgctcaaagaagggattcctcagtgatcggtgagcaccaagaatcaagaaagagaactttttatgtatctaactgtccatttattaaaaatttgccagggcacacccttctgcatgagtgtgcttcagcctgggtgctccagactacaccaaactcatgggatgagccattggtgtgcagggctttaccggtgatggaaactgtatgtgtaaagaatgttattcatgaaaaaccattgctttcatgtaaaacaccttcggcctaggattcctgcctggcacttggatacattacctaactcaataggccagtttagagccacagcctaacctgttcaccaagtaggccaaagccaggcctttcgctccccctgacagagagaagcaaaataaacccaactgggggctttatgaatacagttggctatccatatgtttcttagtttttatgatgcatctggagtagggaaaagtaatgtttcaagacaccatagtaggccagttacattttaattaactcatcgacagtattgacacgtaaatggtatttttcaatctgttctcatcaaaattaaaattagttattgatttagtcatcacatttaagtagaacacatgtggcacaatagtattaagtatatttgagcacttttgcaagacagaaagtatttacaagcatctattgctactttatgcctaatgaaatataaaatgtaggatgatgagagactttgtggcattctttcatttaaacctttatgaaattaaccatctagttcatcattacatactcctagaaaaccatccatttcactgcccacattttggcttcctaccacaaattccacataagacttctctatgaaggaccagtcatttacattgctcatttcattctgtgttcagaagtcagtattgtctttctccaataattaaggtgcaatacaaattaaatcaaccttgattttccagactatttgaataataacttgcttttatggctttaaactccaggtctttcctttttaaaatatttctgcattctcttttatgaactagatcaggatgccttgtttttcctgtgctttcacccccaaaaggttttgtgcatgtgtatgaatacacataatattagtgaatgtgaacccatgttctatacgcactaaacacacagttaatatataaacgcctgcttcatttgtttcaacaccttcattatcaatatgattcatattgatgagatatagtgatgcataatgagccaggcagagagctgaaatgatatcagttaatgatgtcacagtgttagcaccctgcatggatgtggtcaaaatatcattcaagttgtacttcctagtttttatcatcatactactatgtcatatgattttcagactaatttaacatgagaaatgttttggccctaaaggatttcacttaacctagttaccctatttcagtaagtattttggaattcaaccctcgaattattttttctcatttcagcatagtgataggggatgcaatgaggcttcattattttttatgacctgcccctcatttgctctgatgttccctaaattctgtaatcatatcataacttttgttatgaatagagaggaatgggctcactgaaacctgacactagaaattggtgggtgatgctcataactgcaaacacttagcttattgaagtgcctctatttacatgttctttagttataatatgtatttttctaacagaaatacacgtctgtaattggtatatattatactttgtatgtgtcacaacaaaagctaaacagaggctaaagtctttagcagagaagaatgaattacaaatttaccaataagagctctgtttatggttctgtattgaaggacaaccatgacaaccttctgtcattttcacgaaggccaagttggtactttgattatagccatcgtagaacattagcactagaaatctgtctcccttacaatgacttacctagctagcatcaagtaacttgtatcacctgctttaaatgtaagggatagaaaatactattttgtctacactgaaaaacattattattcattgataagtagtaataattataaaagtaacattctttaaagcaaacacattgaaaatattattacaggcagaaccctgatttttaatttatattccctgctgcagacattagccttctttaattcttttgccattacatacatgtttcggctacagactgaacacgaactaaagtccctaaggaggaaaaaaccttaacatattcctgagatgtgattcttttattacttctttttgcaaagctaattatcaaatgatttgattaaacctagacgcattaggaaatgcaagttttacctaaaacttgcagaaatttaaacacatttccatttacttactaacgaacagacctgatttttatttaaaaacacaatttagctttgccaacagaagagtaaaggaaaccataacttataaatttgtaatgtgttcctccttgttggagacattagccagtgtttagttttagaccaacttatacaaacagagtattgatttgtacacattctggagacttgctatatcatggtttgctatggcacagactcagcttagcatggggacattttgaacttcattcaaagttgagtagttactggaacctttgacattgccttgtaatgaggtacttccaaaaaaagacccctaacaatggcataatagtgaggtctctctgtgcatatacataatatatatgcaggataaatgtgtgcaccaatcaaatctaaaattttatgtgactgtcaaatgaatattatttgggttaagatttttcatttctgatttggatagaaaattgctattaatcttgtattaaaatagtttttaaaaatctaaaaaaaaaaaaaaaaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacatttga

SEQ ID NO: 375721 - DNA, 2892 bp, Homo sapiens
  misc_feature (2819)..(2819): n is a, c, g, or t
  misc_feature (2827)..(2827): n is a, c, g, or t
  misc_feature (2833)..(2833): n is a, c, g, or t
ctttctccttccctcttgcctccagtgactgtctccaggatttctctcttcctatttcaggaggactctcacaggctcccacagcctgtgttaagctgaggtttcccctagatctcgtatatccccaacacatacctccacgcacacacatccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggggaacacttaagaatctgtcctcaggaatatacatgctgcaccacagaaatggaagacaagttaagccaacaaagcaaactcgaatttgaaaaccttgtggaagagacaagccattttgtgcgcaccacttttgtgtccaggcataagaaatttgacgaatttttccgagagctcctggagaatgcagaaaagtcactaaatgatatgtttgtacggacctatggcatgctgtacatgcagaattcagaagtcttccaggacctcttcacagagctgaaaaggtactacactgggggtaatgtgaatctggaggaaatgctcaatgacttttgggctcggctcctggaacggatgtttcagctgataaaccctcagtatcacttcagtgaagactacctggaatgtgtgagcaaatacactgaccagctcaagccatttggagacgtgccccggaaactgaagattcaggttacccgcgccttcattgctgccaggacctttgtccaggggctgactgtgggcagagaagttgcaaaccgagtttccaaggtcagcccaaccccagggtgtatccgtgccctcatgaagatgctgtactgcccatactgtcgggggcttcccactgtgaggccctgcaacaactactgtctcaacgtcatgaagggctgcttggcaaatcaggctgacctcgacacagagtggaatctgtttatagatgcaatgctcttggtggcagagcgactggaggggccattcaacattgagtcggtcatggacccgatagatgtcaagatttctgaagccattatgaacatgcaagaaaacagcatgcaggtgtctgcaaaggtctttcagggatgtggtcagcccaaacctgctccagccctcagatctgcccgctcagctcctgaaaattttaatacacgtttcaggccctacaatcctgaggaaagaccaacaactgctgcaggcacaagcttggaccggctggtcacagacataaaagagaaattgaagctctctaaaaaggtctggtcagcattaccctacactatctgcaaggacgagagcgtgacagcgggcacgtccaacgaggaggaatgctggaacgggcacagcaaagccagatacttgcctgagatcatgaatgatgggctcaccaaccagatcaacaatcccgaggtggatgtggacatcactcggcctgacactttcatcagacagcagattatggctctccgtgtgatgaccaacaaactaaaaaacgcctacaatggcaatgatgtcaatttccaggacacaagtgatgaatccagtggctcagggagtggcagtgggtgcatggatgacgtgtgtcccacggagtttgagtttgtcaccacagaggcccccgcagtggatcccgaccggagagaggtggactcttctgcagcccagcgtggccactccctgctctcctggtctctcacctgcattgtcctggcactgcagagactgtgcagataatcttgggtttttggtcagatgaaactgcattttagctatctgaatggccaactcacttcttttcttacactcttggacaatggaccatgccacaaaaacttaccgttttctatgagaagagagcagtaatgcaatctgcctccctttttgttttcccaaagagtaccgggtgccagactgaactgcttcctctttccttcagctatctgtggggaccttgtttattctagagagaattcttactcaaatttttcgtaccaggagattttcttaccttcatttgcttttatgctgcagaagtaaaggaatctcacgttgtgagggtttttttttttctcatttaaaataaaaaaggaagaaagaaaataattttccttgtaaaatcgggccaaaccccaagacagctacattttcaacaaaaaagcaaacagagaaaaataaatgaactttaacactgtaagttcagcattgacagcacttccagtgtaagcttttgggcaancggttaanatgttnggggacggcaaagtggccaagggtgagcagccggctgggggcctcggcctacaaaaaca

SEQ ID NO: 375722 - DNA, 5191 bp, Homo sapiens
gaggttgatgttttgatcaactaacaaatctggagcctgccttcagcttgggtcagcccaaccccagggtgtatccgtgccctcatgaagatgctgtactgcccatactgtcgggggcttcccactgtgaggccctgcaacaactactgtctcaacgtcatgaagggctgcttggcaaatcaggctgacctcgacacagagtggaatctgtttatagatgcaatgctcttggtggcagagcgactggaggggccattcaacattgagtcggtcatggacccgatagatgtcaagatttctgaagccattatgaacatgcaagaaaacagcatgcaggtgtctgcaaaggtctttcagggatgtggtcagcccaaacctgctccagccctcagatctgcccgctcagctcctgaaaattttaatacacgtttcaggccctacaatcctgaggaaagaccaacaactgctgcaggcacaagcttggaccggctggtcacagacataaaagagaaattgaagctctctaaaaaggtctggtcagcattaccctacactatctgcaaggacgagagcgtgacagcgggcacgtccaacgaggaggaatgctggaacgggcacagcaaagccagatacttgcctgagatcatgaatgatgggctcaccaaccagatcaacaatcccgaggtggatgtggacatcactcggcctgacactttcatcagacagcagattatggctctccgtgtgatgaccaacaaactaaaaaacgcctacaatggcaatgatgtcaatttccaggacacaagtgatgaatccagtggctcagggagtggcagtgggtgcatggatgacgtgtgtcccacggagtttgagtttgtcaccacagaggcccccgcagtggatcccgaccggagagaggtggactcttctgcagcccagcgtggccactccctgctctcctggtctctcacctgcattgtcctggcactgcagagactgtgcagataatcttgggtttttggtcagatgaaactgcattttagctatctgaatggccaactcacttcttttcttacactcttggacaatggaccatgccacaaaaacttaccgttttctatgagaagagagcagtaatgcaatctgcctccctttttgttttcccaaagagtaccgggtgccagactgaactgcttcctctttccttcagctatctgtggggaccttgtttattctagagagaattcttactcaaatttttcgtaccaggagattttcttaccttcatttgcttttatgctgcagaagtaaaggaatctcacgttgtgagggtttttttttttctcatttaaaataaaaaaggaagaaagaaaataattttccttgtaaaatcgggccaaaccccaagacagctacattttcaacaaaaaagcaaacagagaaaaataaatgaactttaacactgtaagttcagcattgacagcacttccagtgtaagcttttttgtgacaaatccgggtttaaaaatgcttatggggagaaagcttaaagtttgttctaaatgtagtgaaaatgcactgttgtcttggaggtatcatcttgcactctaaccaaacaacaccaaattaatctggaggtactgatactaaatttggaatcccgtctttaatatgagaacacaaattactacaactcagtacctctgtcttactctgcccaatttcaatttagtaatggcaccattattcttaattcccttaatgtctgtccgctgtatccaattggcacagattttccccttcatcttcaattactagtagctacccccatcaattcaccttcctcaagagtctcaattgaaaataatctttgatgatacaatctctgcttttgccacaggtttgacattaactagacgtttctgcccctgtgctcattaccctcccaaaacaatagtttttttaatgaattgaaacacaattagatccattcctgagttttcatttttaactatttactttgtgtcagttggtttctgcatcacaagggcattctcttacaaaacaactcacaacagaaaaaaaaagtcaagacaaaaaatatatatatatagtattgacatggagatttctttcacttttttagtcttagtatgatcatctatttttatatctatgtatatataaatcacagattttaacttcttaattccaagctcagggttgacacacctttgtaagaaaatgttttgtcaaccagctcttcttgttttgtgctgctcaaagaagggattcctcagtgatcggtgagcaccaagaatcaagaaagagaactttttatgtatctaactgtccatttattaaaaatttgccagggcacacccttctgcatgagtgtgcttcagcctgggtgctccagactacaccaaactcatgggatgagccattggtgtgcagggctttaccggtgatggaaactgtatgtgtaaagaatgttattcatgaaaaaccattgctttcatgtaaaacaccttcggcctaggattcctgcctggcacttggatacattacctaactcaataggccagtttagagccacagcctaacctgttcaccaagtaggccaaagccaggcctttcgctccccctgacagagagaagcaaaataaacccaactgggggctttatgaatacagttggctatccatatgtttcttagtttttatgatgcatctggagtagggaaaagtaatgtttcaagacaccatagtaggccagttacattttaattaactcatcgacagtattgacacgtaaatggtatttttcaatctgttctcatcaaaattaaaattagttattgatttagtcatcacatttaagtagaacacatgtggcacaatagtattaagtatatttgagcacttttgcaagacagaaagtatttacaagcatctattgctactttatgcctaatgaaatataaaatgtaggatgatgagagactttgtggcattctttcatttaaacctttatgaaattaaccatctagttcatcattacatactcctagaaaaccatccatttcactgcccacattttggcttcctaccacaaattccacataagacttctctatgaaggaccagtcatttacattgctcatttcattctgtgttcagaagtcagtattgtctttctccaataattaaggtgcaatacaaattaaatcaaccttgattttccagactatttgaataataacttgcttttatggctttaaactccaggtctttcctttttaaaatatttctgcattctcttttatgaactagatcaggatgccttgtttttcctgtgctttcacccccaaaaggttttgtgcatgtgtatgaatacacataatattagtgaatgtgaacccatgttctatacgcactaaacacacagttaatatataaacgcctgcttcatttgtttcaacaccttcattatcaatatgattcatattgatgagatatagtgatgcataatgagccaggcagagagctgaaatgatatcagttaatgatgtcacagtgttagcaccctgcatggatgtggtcaaaatatcattcaagttgtacttcctagtttttatcatcatactactatgtcatatgattttcagactaatttaacatgagaaatgttttggccctaaaggatttcacttaacctagttaccctatttcagtaagtattttggaattcaaccctcgaattattttttctcatttcagcatagtgataggggatgcaatgaggcttcattattttttatgacctgcccctcatttgctctgatgttccctaaattctgtaatcatatcataacttttgttatgaatagagaggaatgggctcactgaaacctgacactagaaattggtgggtgatgctcataactgcaaacacttagcttattgaagtgcctctatttacatgttctttagttataatatgtatttttctaacagaaatacacgtctgtaattggtatatattatactttgtatgtgtcacaacaaaagctaaacagaggctaaagtctttagcagagaagaatgaattacaaatttaccaataagagctctgtttatggttctgtattgaaggacaaccatgacaaccttctgtcattttcacgaaggccaagttggtactttgattatagccatcgtagaacattagcactagaaatctgtctcccttacaatgacttacctagctagcatcaagtaacttgtatcacctgctttaaatgtaagggatagaaaatactattttgtctacactgaaaaacattattattcattgataagtagtaataattataaaagtaacattctttaaagcaaacacattgaaaatattattacaggcagaaccctgatttttaatttatattccctgctgcagacattagccttctttaattcttttgccattacatacatgtttcggctacagactgaacacgaactaaagtccctaaggaggaaaaaaccttaacatattcctgagatgtgattcttttattacttctttttgcaaagctaattatcaaatgatttgattaaacctagacgcattaggaaatgcaagttttacctaaaacttgcagaaatttaaacacatttccatttacttactaacgaacagacctgatttttatttaaaaacacaatttagctttgccaacagaagagtaaaggaaaccataacttataaatttgtaatgtgttcctccttgttggagacattagccagtgtttagttttagaccaacttatacaaacagagtattgatttgtacacattctggagacttgctatatcatggtttgctatggcacagactcagcttagcatggggacattttgaacttcattcaaagttgagtagttactggaacctttgacattgccttgtaatgaggtacttccaaaaaaagacccctaacaatggcataatagtgaggtctctctgtgcatatacataatatatatgcaggataaatgtgtgcaccaatcaaatctaaaattttatgtgactgtcaaatgaatattatttgggttaagatttttcatttctgatttggatagaaaattgctattaatcttgtattaaaatagtttttaaaaatcta

SEQ ID NO: 375723 - DNA, 1825 bp, Homo sapiens
ctttctccttccctcttgcctccagtgactgtctccaggatttctctcttcctatttcaggaggactctcacaggctcccacagcctgtgttaagctgaggtttcccctagatctcgtatatccccaacacatacctccacgcacacacatccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggggaacacttaagaatctgtcctcaggaatatacatgctgcaccacagaaatggaagacaagttaagccaacaaagcaaactcgaatttgaaaaccttgtggaagagacaagccattttgtgcgcaccacttttgtgtccaggcataagaaatttgacgaatttttccgagagctcctggagaatgcagaaaagtcactaaatgatatgtttgtacggacctatggcatgctgtacatgcagaattcagaagtcttccaggacctcttcacagagctgaaaaggtactacactgggggtaatgtgaatctggaggaaatgctcaatgacttttgggctcggctcctggaacggatgtttcagctgataaaccctcagtatcacttcagtgaagactacctggaatgtgtgagcaaatacactgaccagctcaagccatttggagacgtgccccggaaactgaagattcaggttacccgcgccttcattgctgccaggacctttgtccaggggctgactgtgggcagagaagttgcaaaccgagtttccaaggtaattgaaaacgtgctttctttctcattggtgttccttgtttattctgtttttaaaaccaatgtttaaaaaaaaaaaaaaaaaaaaaaaaccaaggtaaaaattcttaattggtggtccttgctcttaatcagttaaatatcaaagcataattctggctttcttttccttgcattgtgtgagagagaacaggattttaagccattctatgtggtttgaaaattaatgttaatacttatcagcagtatagcagagaagcttttagtaccaatggtgcaaaagcaggcacgttgcaactatgatcatttgatatttctgatcagggttttaaggatgataaatactcatgaaagaatccattcagaggttataatcctctagggagtcaagatgacattttgttggactcaaggtttttttgttctgtttgtgtgttgtgttggttggtttttgagggtgagggag

SEQ ID NO: 375724 - DNA, 2289 bp, Homo sapiens
gggagaagccgagggcagcttagccacggccggttcccgttccctccaggacgcgagggtcgccttgggtggggaacccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaaattgaagttgatggcttcctcttccccaagaacacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttctta

SEQ ID NO: 375725 - DNA, 326 bp, Homo sapiens
gcggccgctccaacatcagaatggtaaccaggacaatgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttctta

SEQ ID NO: 375726 - DNA, 2419 bp, Homo sapiens
gggagaagccgagggcagcttagccacggccggttcccgttccctccaggacgcgagggtcgccttgggtggggaacccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaaggtacccttgctgggagaggggctggggaagggaatgggtcagggagaggttgtgctccctctcctcaagggctcctggattccatatgtcctggttctgcctcctgtgatggcctctgtgcactactcagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaaattgaagttgatggcttcctcttccccaagaacacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttctta

SEQ ID NO: 375727 - DNA, 2098 bp, Homo sapiens
gggagaagccgagggcagcttagccacggccggttcccgttccctccaggacgcgagggtcgccttgggtggggaacccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacagggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaaattgaagttgatggcttcctcttccccaagaacacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttctta

SEQ ID NO: 375728 - DNA, 2228 bp, Homo sapiens
gggagaagccgagggcagcttagccacggccggttcccgttccctccaggacgcgagggtcgccttgggtggggaacccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacagggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaaggtacccttgctgggagaggggctggggaagggaatgggtcagggagaggttgtgctccctctcctcaagggctcctggattccatatgtcctggttctgcctcctgtgatggcctctgtgcactactcagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaaattgaagttgatggcttcctcttccccaagaacacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttctta

SEQ ID NO: 375729 - DNA, 905 bp, Homo sapiens
  misc_feature (44)..(44): n is a, c, g, or t
tagggatagctcagtcttctgtagtcttgggcatctttttttanttgctcattgctggagtggtcacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaaattgaagttgatggcttcctcttccccaagaacacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttctta

SEQ ID NO: 375730 - DNA, 1096 bp, Homo sapiens
gggagaagccgagggcagcttagccacggccggttcccgttccctccaggacgcgagggtcgccttgggtggggaacccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagccaatgcgtttctggaacaggatgtagcaaatagcttccaaggcaaagtagtagaagagttgagccatgtccgacagt

SEQ ID NO: 375731 - DNA, 241 bp, Homo sapiens
ctgtctttctaaaataacttcttacataagtagatccttgttaagttccactaagtaaactaactgaggagcatgaaggaagaaggcatggcttagctaaaaggagaaatgtcccagaaacctccatactgacagccaggaagtagtctcagaggctttggattccaggaaagaagctggtattgtttttctactttaaaaatataactttttttctgctgattccaagaacgtggcaaaa

SEQ ID NO: 375732 - DNA, 2737 bp, Homo sapiens
gggagaagccgagggcagcttagccacggccggttcccgttccctccaggacgcgagggtcgccttgggtggggaacccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaaattgaagttgatggcttcctcttccccaagaacacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttcttaaaaaaaaaaaaaaaagaaaaaaaaaaaaaaacaaaacaccaacaacaataaaaataagaatcacacgcaataccaaccaacaccacaaggaggcgcgcgcgctaaaagtccaccgcacgggggcagccacactgtgcgaccgcaacgaggcgcggcgcacagacgaccccacgaagagcgccgacactaaaaaaatgaaccaagtcgtgcgcgagttgacacaaacacaggagtggcgtgagaaaagactgccgagcagagtgaaaattataagtaagaccgacacaactagttgtaggggtagcacataatgtggggacaaacacaccaagaaggtaattagagccacaggagaaagataccacccactgcaggacatgtaatggtgactaagacagtggtctgattgcggtagaaaatgtgcgagtgaggttattagcacaattac

SEQ ID NO: 375733 - DNA, 1796 bp, Homo sapiens
gggagaagccgagggcagcttagccacggccggttcccgttccctccaggacgcgagggtcgccttgggtggggaacccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaactccttgcacacaccctgagcttttgccacttctatcatttttgagcaactccctctcagctaaaaggccacccctttatcgcattgctgtccttgggtagaatataaaataaagggacttttatttctta

SEQ ID NO: 375734 - DNA, 1707 bp, Homo sapiens
catgaaggaagaaggcatggcttagctaaaaggagaaatgtcccagaaacctccatactgacagccaggaagtagtctcagaggctttggattccaggaaagaagctggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaaattgaagttgatggcttcctcttccccaagaacacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttctta

SEQ ID NO: 375735 - DNA, 1501 bp, Homo sapiens
gggagaagccgagggcagcttagccacggccggttcccgttccctccaggacgcgagggtcgccttgggtggggaacccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaatgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttctta

SEQ ID NO: 375736 - DNA, 1167 bp, Homo sapiens
gggagaagccgagggcagcttagccacggccggttcccgttccctccaggacgcgagggtcgccttgggtggggaacccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtaacccgcgggggcatcgcgtcctggggatgggagtgggcaccggaacagagaggctagaggtgagaagacgttggacagaaagtgaaggctgcaggaactcagctggggacccactgaggctatggtcataaactggaaatcagtagggagaatgggcaaagtgcagacagagccctttgagctgagataaacaggacgaggaagggcttaaatcaggacggcaccagtaagggggggatctggacgccggacttacagtgagcagaggttgaggagggagctgtcttgggaagagagtggcagatgcaaatgtgtaagctaacagatattatggaatcactaattctgggctgatattggctaccacagacttcttccaaacgaaataacttcaggaggattatagaaacctcttggttatttgcaaggtaatttcctcttaggggatacacgatcgcgaggacctcagatcgt

SEQ ID NO: 375737 - DNA, 644 bp, Homo sapiens
gtgtaagtctcatatgccatctattaatttttgaaacttttatcaactgggcgtagtggctcatgcctgtaatcccagaactttgggaggcagaggcgggcagatcacctgaggtcgggagttcgactccagcctgggtgacagagcaagaccctgtctctttaaaaaaaaagaaaaagaaaaagaaaaagcccgcttcagaaaagcttgtcattatccataggatacgatacttaattttacgcttccttatttcttaggtggtccacaattagtgaaaatctgtttgcaaccactggttatcctggcaaaatggcaagccagtttcaaattcatcatttaggacaccctcaggtaatgtggaaatgttttgtaacatacgtgctttttttttttaatttgtgtttttgacttttccactcatagcccccaatttgtaatttgttgactgaagacatttacgtttgttatctgcttaaattgcaagaaatggtggttcatttgtttttgttttttgtgtggtttttttttgatgtttacattaccagtgacacaggtttttttggccagtattcatataagaagctttttattctgttgcttttatattttcttctttagtttaaatacataacgttgcttgt

SEQ ID NO: 375738 - DNA, 485 bp, Homo sapiens
ctgtaccagttattcatagatggattgtatcccatgtttcagctgcgtatcaataatgtgtatttcacctgtaagggagcatatttttaaattttgtttatgctacaaagataaatcatcaatgcatttcatatttttgaaagtcatttttatttattaattttggggacttactgtgcttctttaattcttcacatattttatagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaatta

SEQ ID NO: 375739 - DNA, 1279 bp, Homo sapiens
gcgacagcgcgtcgcggcagcccccaaggaagaccagcctgcctctggtcggttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagctaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccagttatcctcaaaataagagacctgttcacatggatcgagcctgcttattcaggtggtccacaattagtgaaaatctgtttgcaaccactggttatcctggcaaaatggcaagccagtttcaaattcatcatttaggacaccctcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaatta

SEQ ID NO: 375740 - DNA, 2021 bp, Homo sapiens
  misc_feature (29)..(30): n is a, c, g, or t
aatataggctaggtagcgaggcgggtggnncaggaagaccagcctgcctctggtcggttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagctaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccagttatcctcaaaataagagacctgttcacatggatcgagcctgcttattcaggtggtccacaattagtgaaaatctgtttgcaaccactggttatcctggcaaaatggcaagccagtttcaaattcatcatttaggacaccctcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaattaaaaaaaaaaaaaaaaaaaaaaaaaaaaaaaaaaaaaaaaaaaaaaaaaaaaaaaaaaaaaaaaaaaaaaaaaaaaaggaggggggggggcgaaaaaatttcccggggggggggcgcatgcccttttttgtgtaaggggggccccaaaggggggtttaaaaaacaaaggagcaggcgccgacttaaacacaacacgccggcgggacgaaaaccacgtccgctggccgggcacacttgggggagaaaccccccctctcgcgggcgggcggccaaattagtgggagacaaccacccaggcagagaaatatgccccccagaggtaaaaaacaacctcagacggatcaacgctgggtacccagctgctatagccgcgccggtggagaaaaatggctcagcgcgttcgtttttgtccaactatctacacggacggcgcggcacaaaacacatgcggagaacacggtaagcagacgaagccaacggcagcaaacagaccaaagaggaaagacgaaaggccatcacgactaacagacaagcaaggaacgactcagacgccgacgaaaacacaaaagacaacacacagacacggagaccaacgccaccgacaccagcaccgtacgcaaacagaaaagccaatcgaacagctagaagcggtcaagacagacaagaacgacgacaagcacgagagcacaagcacaaccgaaacggaggccagacgagcgagaacagcacaagcgacat

SEQ ID NO: 375741 - DNA, 1437 bp, Homo sapiens
gcgacagcgcgtcgcggcagcccccaaggaagaccagcctgcctctggtcggttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagatatgaaagataactccaggtcactcaacaggtttaaatggtacagctcaggagttttgatgccaaatcccacattcttgccaatctaccactactatttacaccttcaaggatttttcaacttaatagaaccagaattaaaagaacactgcttaaaactaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccagttatcctcaaaataagagacctgttcacatggatcgagcctgcttattcaggtggtccacaattagtgaaaatctgtttgcaaccactggttatcctggcaaaatggcaagccagtttcaaattcatcatttaggacaccctcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaatta

SEQ ID NO: 375742 - DNA, 2083 bp, Homo sapiens
  misc_feature (29)..(30): n is a, c, g, or t
aatataggctaggtagcgaggcgggtggnncaggaagaccagcctgcctctggtcggttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcagaaccttcaagttccattgcacccagtttcatgcctcttgtcttgagagaaaactaagtaaaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagctaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccagttatcctcaaaataagagacctgttcacatggatcgagcctgcttattcaggtggtccacaattagtgaaaatctgtttgcaaccactggttatcctggcaaaatggcaagccagtttcaaattcatcatttaggacaccctcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaattaaaaaaaaaaaaaaaaaaaaaaaaaaaaaaaaaaaaaaaaaaaaaaaaaaaaaaaaaaaaaaaaaaaaaaaaaaaaaggaggggggggggcgaaaaaatttcccggggggggggcgcatgcccttttttgtgtaaggggggccccaaaggggggtttaaaaaacaaaggagcaggcgccgacttaaacacaacacgccggcgggacgaaaaccacgtccgctggccgggcacacttgggggagaaaccccccctctcgcgggcgggcggccaaattagtgggagacaaccacccaggcagagaaatatgccccccagaggtaaaaaacaacctcagacggatcaacgctgggtacccagctgctatagccgcgccggtggagaaaaatggctcagcgcgttcgtttttgtccaactatctacacggacggcgcggcacaaaacacatgcggagaacacggtaagcagacgaagccaacggcagcaaacagaccaaagaggaaagacgaaaggccatcacgactaacagacaagcaaggaacgactcagacgccgacgaaaacacaaaagacaacacacagacacggagaccaacgccaccgacaccagcaccgtacgcaaacagaaaagccaatcgaacagctagaagcggtcaagacagacaagaacgacgacaagcacgagagcacaagcacaaccgaaacggaggccagacgagcgagaacagcacaagcgacat

SEQ ID NO: 375743 - DNA, 1222 bp, Homo sapiens
ctgtaccagttattcatagatggattgtatcccatgtttcagctgcgtatcaataatgtgtatttcacctgtaagggagcatatttttaaattttgtttatgctacaaagataaatcatcaatgcatttcatatttttgaaagtcatttttatttattaattttggggacttactgtgcttctttaattcttcacatattttatagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaattaaaaaaaaaaaaaaaaaaaaaaaaaaaaaaaaaaaaaaaaaaaaaaaaaaaaaaaaaaaaaaaaaaaaaaaaaaaaaggaggggggggggcgaaaaaatttcccggggggggggcgcatgcccttttttgtgtaaggggggccccaaaggggggtttaaaaaacaaaggagcaggcgccgacttaaacacaacacgccggcgggacgaaaaccacgtccgctggccgggcacacttgggggagaaaccccccctctcgcgggcgggcggccaaattagtgggagacaaccacccaggcagagaaatatgccccccagaggtaaaaaacaacctcagacggatcaacgctgggtacccagctgctatagccgcgccggtggagaaaaatggctcagcgcgttcgtttttgtccaactatctacacggacggcgcggcacaaaacacatgcggagaacacggtaagcagacgaagccaacggcagcaaacagaccaaagaggaaagacgaaaggccatcacgactaacagacaagcaaggaacgactcagacgccgacgaaaacacaaaagacaacacacagacacggagaccaacgccaccgacaccagcaccgtacgcaaacagaaaagccaatcgaacagctagaagcggtcaagacagacaagaacgacgacaagcacgagagcacaagcacaaccgaaacggaggccagacgagcgagaacagcacaagcgacat

SEQ ID NO: 375744 - DNA, 419 bp, Homo sapiens
acttaaagtatgagaaaatatttatggaatattttcctggaattcccggtctaattgtaaagacatattaacaaatttaggattattaaaatcactggttttatacaaaaagaaacctgtttctgtctaggtgctatggctcatacctataatcccagcacttcaggagaccaaggcaggaggatcacttgaggccaggagtttgagacctgcctgggcaagatagcaagaccccattcctacaaaaaacaaaaaattaaaacttacctgggcatcgtagtacacacctgtagtcccagctactagggaggctgaggtgggaagatcacttgagcccaggaatttgaggctacagtgagttttgttagcacttctgcactccagcctgggtgacagagcaagaccctgtctctttaaaa

SEQ ID NO: 375745 - DNA, 1284 bp, Homo sapiens
  misc_feature (29)..(30): n is a, c, g, or t
aatataggctaggtagcgaggcgggtggnncaggaagaccagcctgcctctggtcggttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagctaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccagttatcctcaaaataagagacctgttcacatggatcgagcctgcttattcaggtggtccacaattagtgaaaatctgtttgcaaccactggttatcctggcaaaatggcaagccagtttcaaattcatcatttaggacaccctcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaatta

SEQ ID NO: 375746 - DNA, 1258 bp, Homo sapiens
cacctctgaccgagttccacctctgaccgagttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagctaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccagttatcctcaaaataagagacctgttcacatggatcgagcctgcttattcaggtggtccacaattagtgaaaatctgtttgcaaccactggttatcctggcaaaatggcaagccagtttcaaattcatcatttaggacaccctcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaatta

SEQ ID NO: 375747 - DNA, 2010 bp, Homo sapiens
  misc_feature (594)..(594): n is a, c, g, or t
  misc_feature (606)..(606): n is a, c, g, or t
  misc_feature (624)..(624): n is a, c, g, or t
  misc_feature (633)..(633): n is a, c, g, or t
  misc_feature (653)..(653): n is a, c, g, or t
  misc_feature (656)..(656): n is a, c, g, or t
  misc_feature (680)..(680): n is a, c, g, or t
  misc_feature (698)..(698): n is a, c, g, or t
  misc_feature (710)..(710): n is a, c, g, or t
  misc_feature (725)..(725): n is a, c, g, or t
  misc_feature (735)..(735): n is a, c, g, or t
  misc_feature (777)..(777): n is a, c, g, or t
  misc_feature (779)..(779): n is a, c, g, or t
  misc_feature (782)..(782): n is a, c, g, or t
  misc_feature (788)..(788): n is a, c, g, or t
  misc_feature (812)..(813): n is a, c, g, or t
  misc_feature (839)..(839): n is a, c, g, or t
  misc_feature (848)..(848): n is a, c, g, or t
  misc_feature (859)..(861): n is a, c, g, or t
  misc_feature (867)..(868): n is a, c, g, or t
  misc_feature (882)..(882): n is a, c, g, or t
  misc_feature (885)..(887): n is a, c, g, or t
  misc_feature (901)..(901): n is a, c, g, or t
  misc_feature (908)..(908): n is a, c, g, or t
  misc_feature (914)..(915): n is a, c, g, or t
  misc_feature (917)..(918): n is a, c, g, or t
  misc_feature (923)..(924): n is a, c, g, or t
  misc_feature (932)..(932): n is a, c, g, or t
  misc_feature (935)..(935): n is a, c, g, or t
  misc_feature (949)..(950): n is a, c, g, or t
  misc_feature (962)..(962): n is a, c, g, or t
  misc_feature (977)..(977): n is a, c, g, or t
gcgacagcgcgtcgcggcagcccccaaggaagaccagcctgcctctggtcggttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggaacatggaagnagagcaaacagnacaatatgaacaacaatnacctagcangagtgtgagctggcaaccanagnaaaaaaaaaaacaaaaggaagcanagaagaaaggaaaaaacnaaaaaaaaaaanaaatagcccaacaanaaaaaaaaanacaaaaaacagaacaagaaccaaaaaacccagcacacaggancnccnaaaacncccccaaagccggagccgtcgcannaaaaaaacgccccacccccccccccnccccccccncccaccccccnnnccacanncccccccacacggnccnnncccccccacccagncggcccncaaccnncnnaaacnngcgggcanccnccggccggcccggnngaagggcaagcngggggggaaggcggnaggtaggacacccgcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaattaaaaaaaaaaaaaaaaaaaaaaaaaaaaaaaaaaaaaaaaaaaaaaaaaaaaaaaaaaaaaaaaaaaaaaaaaaaaaggaggggggggggcgaaaaaatttcccggggggggggcgcatgcccttttttgtgtaaggggggccccaaaggggggtttaaaaaacaaaggagcaggcgccgacttaaacacaacacgccggcgggacgaaaaccacgtccgctggccgggcacacttgggggagaaaccccccctctcgcgggcgggcggccaaattagtgggagacaaccacccaggcagagaaatatgccccccagaggtaaaaaacaacctcagacggatcaacgctgggtacccagctgctatagccgcgccggtggagaaaaatggctcagcgcgttcgtttttgtccaactatctacacggacggcgcggcacaaaacacatgcggagaacacggtaagcagacgaagccaacggcagcaaacagaccaaagaggaaagacgaaaggccatcacgactaacagacaagcaaggaacgactcagacgccgacgaaaacacaaaagacaacacacagacacggagaccaacgccaccgacaccagcaccgtacgcaaacagaaaagccaatcgaacagctagaagcggtcaagacagacaagaacgacgacaagcacgagagcacaagcacaaccgaaacggaggccagacgagcgagaacagcacaagcgacat

SEQ ID NO: 375748 - DNA, 459 bp, Homo sapiens
  misc_feature (15)..(15): n is a, c, g, or t
  misc_feature (22)..(22): n is a, c, g, or t
cgttctgtaggaatncggcacnagggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375749 - DNA, 460 bp, Homo sapiens
tactactaaattcgcggcccgtcgacgcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375750 - DNA, 502 bp, Homo sapiens
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375751 - DNA, 460 bp, Homo sapiens
ggacgcgtgggtcgcccacgcgtccggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375752 - DNA, 468 bp, Homo sapiens
tatggctagtacgaggctgggtggttagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375753 - DNA, 721 bp, Homo sapiens
  misc_feature (18)..(18): n is a, c, g, or t
  misc_feature (554)..(554): n is a, c, g, or t
  misc_feature (556)..(556): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaaaaaaaaaaaaaaaaaaaaaaaaaaaaaaaaaacggggggggttatntntggggggggggaaacaaaaagggtgttttgaaaggggcgcgggtggccacaaggtgtgtttcccgcaggacaccccttttttgtttaaccaggggggaacatcgggggggaccccaaaataggggggggcaaaaattgtaaacccgggttatgtgttattttttt

SEQ ID NO: 375754 - DNA, 681 bp, Homo sapiens
  misc_feature (493)..(493): n is a, c, g, or t
  misc_feature (508)..(508): n is a, c, g, or t
tatggctagtacgaggctgggtggttagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaaanaaaaaaaaaaaaaanaaaaaaaagaaacaaaagaaaaccccggagcgacacaaagagagagacgacgcacacaaagaggaacaaagacgcggcaaatagaaaacaagagaccacgacacacaaatctatagcaacaaagggggagaaaccgcggggaacccataaaggggacacaaaaaacgcgaaag

SEQ ID NO: 375755 - DNA, 1217 bp, Homo sapiens
tgagtgacgacagtacaaaagtctggagaaagccccaaagtagtcccctgttcccagagccccaagaataaacagatgggagaacaagaccctcctcttccgtttcccccacagagagatccctgtgacacatctaccgggacccctcgaaatattcctgggaacttcgggaccaaaaagaacatagcgcaccaagagaccccaggttcccaggttattcccccagttgggtaggggacaggcctgctctcggggagggtagcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaacacccaacaacaaacaaaaaaaaaagacgaggggggggcgcgcctcaaagaagatatcccgcgcgcgaggggggcgcccagagtttagcagcgcgtcacgccgaggttttgcgtgtggaacagaggggggcgccccaaagagaggagagagcgcgcgaaataaagaagagccgaaagagcaccgtgggccgcagcagttgataaacacaacgacctgggagacgtggggaaaacacggtgcgaaccaggggcgaacccgtgggagaagaggaacccttaactcggggggggcgggcgaaccatatagggggggggcacaaaagattacactctaagcggaaggattttgaagagggcgccacaaaggggggaaacattatttatcaaattttagagaggggggtataacagcggggggtttaaaaccacatggagcggatattatggtatagggaggagagtaaaaaaagtgtggcgataacaggggaggaatatgcacaatggcacacattcttt

SEQ ID NO: 375756 - DNA, 296 bp, Homo sapiens
ggacgcgtgggtcgcccacgcgtccgccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375757 - DNA, 342 bp, Homo sapiens
tactactaaattcgcggcccgtcgacgcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacaaaaaaagtcgacgcggccgcgaatttagtagtagtaggcggccgc

SEQ ID NO: 375758 - DNA, 409 bp, Homo sapiens
aaatcagctcggtaccactcttcttcagcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375759 - DNA, 503 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375760 - DNA, 293 bp, Homo sapiens
gtcccttcgcgggaaggccgcaggtccaggggcttgtacttcttgcccttgtagaatttcctgaggttttctttctgagtctggttaataactgtgagaacacagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375761 - DNA, 533 bp, Homo sapiens
atgtgactgtcctcgtgactgggaatcgggcagtggaaggagcactgagttgggagtcacttgactgagatgcaagccccggctcttccacagctttgccaagacttggacactcagcccagtaggtcagcagacttacatgaaatgaggatggtcccaccagccttagatttggggggattaattgagttagtgacatgtgtggcctgctggcagtcccatggtggcagcctcctcctgagtggctctggatggccctccccagcccccttagctgctgcagtagctcctcagccctgggtccttggattcaccctgccgtctgtctcccaggaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375762 - DNA, 231 bp, Homo sapiens
tagcctctcaatagatggagacatacagaaatagtcaaccacatctacaaatgccagtatcaggcggcgcttcgaagccaaaaaacacgtgccatgcggccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375763 - DNA, 462 bp, Homo sapiens
tggcgaattcggcacgagggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375764 - DNA, 257 bp, Homo sapiens
gtcccttcgcgggaaggccgcaggtccaggggcttgtacttcttgcccttgtagaatttcctgaggttttctttctgagtctggttaataactgtgagaacacgggcaatggatttccggacgactcggatcttagagagcttggagaacctgaagaccaagaagcagcagcggaaggagcggctgtacccgctgcggaagtacgcggtcaaggcctgaggggcgcattgtcaataaagcacagctggctgagaaaa

SEQ ID NO: 375765 - DNA, 1166 bp, Homo sapiens
  misc_feature (1)..(1): n is a, c, g, or t
ncgagctgctgactaatatgatgttaacatcaatgataaatttatatgtatacttagttatatatatatcatgtgaagcttattactacagcctcggttacaacactttgtttttaacacattatggcgatggtcgccccctggttgttgttgtgtgttttacggtcatcattttattaaacatgttggccattcagtgctctcttttataatcactttttttcgtgtggattgttccttcacaccaggatgttctcctcccccgggaataatcttggtggtaatttgtcttcccccggcttataaagggggtatattatgggcgagagtaacccgagggcgcaaacagtcccccaaaaaaggtgggactggccatttcgggaaccccacgttccgtgcccacagtgtaaatggactggatgttccagaagcccttcaaagacccagaaattttgtgggcctctaaaaggcaacatctcaaggttctaaaggaaacagggataccgtccttccagttaagacgggattaactgggcttggtgttcaagtcccccccaggtcctccggatctaccgggtttcccaggggaggaatgaaaggttttttggcatacaaaagtataaatgtagtgacagctgaccatttagtagaacgagcctcgcctttacacagctttatattacaactaggaaaaggctatgttttctctctccccacccccaagcctactccgcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375766 - DNA, 459 bp, Homo sapiens
ctgaggtgctctagaggatccccaggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375767 - DNA, 857 bp, Homo sapiens
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaacaaaaaaaaaaaaaacaaaaaaaaaaaaaaaaaaaaaaaaaaaagggggggggggggcataaaataattccccgggggggggcaatttgggcccctttttttagaaaaaggggggcccacataatgaggggggagcgtatattaaaaacacagaagcggcgggcgcgggttaaacaacacgctggtggagagaaaaatggttgcaggcgatttaggaagaaaacccatttcgggggggggaatatgggaccacaactagaaatatacgtgaggagaaaatactaggagagagtggacccgtattttcgggaaactgtaggtatagtaattag

SEQ ID NO: 375768 - DNA, 814 bp, Homo sapiens
  misc_feature (15)..(15): n is a, c, g, or t
  misc_feature (22)..(22): n is a, c, g, or t
cgttctgtaggaatncggcacnagggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaacaaaaaaaaaaaaaacaaaaaaaaaaaaaaaaaaaaaaaaaaaagggggggggggggcataaaataattccccgggggggggcaatttgggcccctttttttagaaaaaggggggcccacataatgaggggggagcgtatattaaaaacacagaagcggcgggcgcgggttaaacaacacgctggtggagagaaaaatggttgcaggcgatttaggaagaaaacccatttcgggggggggaatatgggaccacaactagaaatatacgtgaggagaaaatactaggagagagtggacccgtattttcgggaaactgtaggtatagtaattag

SEQ ID NO: 375769 - DNA, 792 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaaaaaaaaaaaaaaaaaaaaaaaaaacaacaccccctcccattcactaacactcccactaatccccctatttccccccttttcctcatcatcttaccttttttttttttttttttgcgggccccttgggccccatgtttttttattttgggagagttttttgttggggcgccaatttgaggtcatttggccaattgccccttatggggagggttaaacaattccggccggtgttttaaaagggggagtggaaaaccccgggggttccccaataaatagcgtggggg

SEQ ID NO: 375770 - DNA, 855 bp, Homo sapiens
  misc_feature (18)..(18): n is a, c, g, or t
  misc_feature (644)..(644): n is a, c, g, or t
  misc_feature (855)..(855): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaacaaacacctttgtgggcgccgcgccttgggcccttgagaaaagttttaaagagcccattttcgttgggggcgcgggggccccagtaacggatacgggagaccctggcgccacaagcggggctcccaaaagggaagncgtccgggcggcaagcgagacaaagggcggcggggggatctctcccccacaaaataaaaaaagccgcccggggggggacaacagagcggcgtctcggagaacacaactctcacaaagggagacccgggagggaccaaagcggcgacgctcactacacacggagggctcaagggacgccgaaatataaattagggggcccgcggggggaagn

SEQ ID NO: 375771 - DNA, 872 bp, Homo sapiens
  misc_feature (661)..(661): n is a, c, g, or t
  misc_feature (872)..(872): n is a, c, g, or t
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaacaaacacctttgtgggcgccgcgccttgggcccttgagaaaagttttaaagagcccattttcgttgggggcgcgggggccccagtaacggatacgggagaccctggcgccacaagcggggctcccaaaagggaagncgtccgggcggcaagcgagacaaagggcggcggggggatctctcccccacaaaataaaaaaagccgcccggggggggacaacagagcggcgtctcggagaacacaactctcacaaagggagacccgggagggaccaaagcggcgacgctcactacacacggagggctcaagggacgccgaaatataaattagggggcccgcggggggaagn

SEQ ID NO: 375772 - DNA, 814 bp, Homo sapiens
tactactaaattcgcggcccgtcgacgcggcgttggcggcttgtgcagcaatggtgagagctgcggaatcgggcgccatccgagcgctgtgaggcgcgggggttggggaaggcggtgcgggctgagcccgcggattctatctgccacctaggcctgtggggcgccgcgcagaatggtctggcgccaccacaacccgcctcttcgcttggcgccgggagaggcgcgcggcccgggcctgggttactctgcccaaggcacggccggcgagggagactgtcctgagccctggttggggctccggcgcactcgtagtcgatggcgagtcgcgcgcctttgggggctggccacgcaggtgaaggggatatggccccgcggcctggctgaggcacactctctcttgcgcgcaggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375773 - DNA, 767 bp, Homo sapiens
ggacgcgtgggtcgcccacgcgtccggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaaaaaaaaaaaaaaaaaaaaaaaaaacaacaccccctcccattcactaacactcccactaatccccctatttccccccttttcctcatcatcttaccttttttttttttttttttgcgggccccttgggccccatgtttttttattttgggagagttttttgttggggcgccaatttgaggtcatttggccaattgccccttatggggagggttaaacaattccggccggtgttttaaaagggggagtggaaaaccccgggggttccccaataaatagcgtggggg

SEQ ID NO: 375774 - DNA, 1007 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaacacccaacaacaaacaaaaaaaaaagacgaggggggggcgcgcctcaaagaagatatcccgcgcgcgaggggggcgcccagagtttagcagcgcgtcacgccgaggttttgcgtgtggaacagaggggggcgccccaaagagaggagagagcgcgcgaaataaagaagagccgaaagagcaccgtgggccgcagcagttgataaacacaacgacctgggagacgtggggaaaacacggtgcgaaccaggggcgaacccgtgggagaagaggaacccttaactcggggggggcgggcgaaccatatagggggggggcacaaaagattacactctaagcggaaggattttgaagagggcgccacaaaggggggaaacattatttatcaaattttagagaggggggtataacagcggggggtttaaaaccacatggagcggatattatggtatagggaggagagtaaaaaaagtgtggcgataacaggggaggaatatgcacaatggcacacattcttt

SEQ ID NO: 375775 - DNA, 777 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaaaaaaacaaaaaccgcggggccaatatggggggggggggaaacaaggggtaaaaatgggcatggggctgaacggggcgttccggaggacccgagttctttgttgaccaaggggcgggaaacctgggggggcaccccaaatgggagggggacgccaaaaatgtggcataaaccgcccggggaagcccgctttaaagactctggccggcaagaaccggaatcctggagtacgatgcatgatcttggagcacaggggcacttagactgtagac

SEQ ID NO: 375776 - DNA, 1133 bp, Homo sapiens
  misc_feature (18)..(18): n is a, c, g, or t
  misc_feature (496)..(496): n is a, c, g, or t
  misc_feature (1118)..(1118): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaanaaaaaaaaaaaaagggggggccccccatacccttttttataagcccttttaaaaaatttacccttgcaagcttccccgtcccgggggttccccccttcttaaatctcaccaggatcagacgggggacaaagcttcaacgcacaagcagccagggcgaggctcaaaacggtttaagcatagccaaacccccagggggaacaacaacgcagcgtgataaacccgtttggcactaaacccgaaacgttacccaaaggcatattagctaacccccgaggggtgggccaattctgggtgcacagccaccgggggtcaccggatttaaccccagggtcaaatagaacggccgggggaacaacggtgggtgttagatagcccccctccccaaataaaggctaaaagccctcaccctcggagttggtaaaaacacctcccagcgtttgaccccaacaagtaggactaccgacaaagggggtttcacccatcttctggacccccagttagcgtaagaccccaacggggatttagatacccccgtatggttaagccctaaccctgcacggtaattcaccaaaattgtccgccagaaacttacgaccacgttaacccaacggcgcggcgcgtncaatccctaaaggcg

SEQ ID NO: 375777 - DNA, 870 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaacaaaaaaaaaaaaaacaaaaaaaaaaaaaaaccccggggccttttttgcgcagggggggagaaacacgagggtcattaaattggcgagcattggcacaaagtggttcccaggaacccacgtttttttgtgccacaggtgggagaaacagacggggccccccaataaagagggagcgcccaaaataatatgcgaaaagcgacgggttacctgtagaattcagtgggcaatgaaaattcggcgagaaataacaccgcagaaatgcgcagaggctaattaggaagcacacaaaagatctctcaaagcagctttgcgcgagagaactcgtggttctaaaaaacaaccgaacccagcgggtgttttcgcgcaaagacacacacttctcgc

SEQ ID NO: 375778 - DNA, 1186 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaaaaaaaaaaaaaaaaaaaaaaaaaaagaaagaaaaaaaaaaccacctcaaatgacgcgcaccaacagccactcacgtgacacgctggtgaccctaaggcacggggcgccgtgcatccctggtgtgagtcaagacgagagtaggaatgaggttgggggaggtgggaaggggagaggctaggggcgcggtgggccgctagcgagaccgtatcgtgggtgcaggtggggtagggtggagagagcagcgagcgcccgtcagaagaagagacgcgcgcagcaggagcgcacggctgaagattagtagacggtcgcatattgacaaaatggagttgatttgcctgagcatgagttctgcagcgctgtgcgtcgttgtgagaacaggacacgagcggttattatagatatataagatgtataagaccgatcgattgcattgcgtctcatgctcgagctacacagcctcgtactcttgtagggaggcggagtaggagggaggaggggttgctgtgcgtcgtattgcacaggtgctcggtcgtgtcgagctggggggatgaggagtgagagtggaaggatcggagttgcggcagggagagagaggtgggtaggaggtggtgggagggagggtggaggaggtgggcctgggggggagctaggtgaagctagaagcaggggcgagacggt

SEQ ID NO: 375779 - DNA, 775 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaacacaacaaaaaaggggggggaccggtagccaattcgccctatagagagtcgaatcacaattcactggccgtcagttacaccgtcgtgactgggacaacctggggtatcccagttaatcggactggagaaaatcccgtattggcaggtagagtaataagcacatggccgacagatagcattccagggttgcgcacctaatggcgatggaacttgacggtatatttgggaacacgcgtaaatttgatcgcgatattcacactggcacatcgacaccatgacaccatgtgcg

SEQ ID NO: 375780 - DNA, 590 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaatataataactttatttgtgttttacctacctctgtaaataaatatactatttttttttttccttgggggggggcccgtcccacaattccccttattgggttgtt

SEQ ID NO: 375781 - DNA, 638 bp, Homo sapiens
  misc_feature (518)..(518): n is a, c, g, or t
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaagaatnataataatatttattataatttaacatttaatatatttttacttatatcttttttatatattttatttattttaatttttactaatccccttcttttacaccttccccctcctcttccct

SEQ ID NO: 375782 - DNA, 541 bp, Homo sapiens
tactactaaattcgcggcccgtcgacgcggcgttggcggcttgtgcagcaatggtgagagctgcggaatcgggcgccatccgagcgctgccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaagtcgacgcggccgcgaatttagtagtagtaggcggccgc

SEQ ID NO: 375783 - DNA, 793 bp, Homo sapiens
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatgtaagtgaggcggccggatcacagccctcgtgggtggggagcacgtgtgcatcgggatcgtcggaggatttcaaagttggcttaaggagctggccgcttagatgcccactccgtgcatcctggcgcgcatgggagacccgttgtgtgcttagcctcttacctgccttgaccttgcggtccttgtgcctggaatgcatccccggagacccatcttaatgctgccttcaaagcctacccggaccccttccttccgcttcccaccaacacttgagtttttaacccccttggcagccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375784 - DNA, 493 bp, Homo sapiens
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375785 - DNA, 441 bp, Homo sapiens
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaagggcaagaagtacaagcccctggacctgcggcctaagaagacacgtgccatgcgccgccggctcaacaagcacgagagaacctgaagaccagaacagcacggaagacgctgtaccctgcgaatacaggtcagcctga

SEQ ID NO: 375786 - DNA, 472 bp, Homo sapiens
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggagccggcgcgttgggggggacaggaagacactgggctttccaggatagcttgcttcagctcgtagaacacagcagagtcctcttttgtgaggaaggtgatggccaccccactcttgcctgctcgtcccgtgcggccaatgcggtggatgtaatcttcaatatttttggcc

SEQ ID NO: 375787 - DNA, 390 bp, Homo sapiens
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgggcctaagagacaggcccttgggcgcggttcacagcacgggggacctga

SEQ ID NO: 375788 - DNA, 485 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375789 - DNA, 531 bp, Homo sapiens
cagcacgttcttcctctgaggacctttatataagccccctatacccccagaggaatgcatccagaactttaaacaggctgggtcaacaacaaggggcgcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375790 - DNA, 722 bp, Homo sapiens
  misc_feature (542)..(542): n is a, c, g, or t
cagcacgttcttcctctgaggacctttatataagccccctatacccccagaggaatgcatccagaactttaaacaggctgggtcaacaacaaggggcgcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaanaaaaaaaaaaaaacccctgttgggccgccttggcccaatcgattctttactccgacaaacttttgccttgcggcccgaatttgagcccacttgggccattcgccctataggggggcgtattaaaaatacttggccgccggttaaaacccgtggcggggaaaacacccggggtgccccact

SEQ ID NO: 375791 - DNA, 673 bp, Homo sapiens
gcccgccgccacccggcagtagttgcggaggtcagccccgcctacttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatgtaagtgaggcggccggatcacagccctcgtgggtggggagcacgtgtgcatcgggatcgtcggaggatttcaaagttggcttaaggagctggccgcttagatgcccactccgtgcatcctggcgcgcatgggagacccgttgtgtgcttagcctcttacctgccttgaccttgcggtccttgtgcctggaatgcatccccggagacccatcttaatgctgccttcaaagcctacccggaccccttccttccgcttcccaccaacacttgagtttttaacccccttggcaggtgggtggcttgcaccctggagtggcagcgtaagttattttacatggctaagagtgcgggagacttgtgaaaggaacatgggtttggagttcatcaacctgggtacaaagtccacttctcaaaaaaaaattagatgggtgtggtggtac

SEQ ID NO: 375792 - DNA, 274 bp, Homo sapiens
agagagagagagagagagagagagagagagagagagagagagagagagagagagagcaatggactcagaaagaaaacctcaggaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375793 - DNA, 812 bp, Homo sapiens
agagagagagagagagagagagagagagagagagagagagagagagagagagagagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaggcagcagctggtgggccctgcatacagatggacagagtactgcctcagcccccagcatgctcttgctaaccagagccgaggaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaaaaaaaaaaaccgggggatcatggggggggggggacacaaaggcgacttcggaagggcccctggggccatcagagtgtttccgggaacacaactttccgttgctcacaagcgggcgaaactcgggcgggggcccaaataggggggcgacaaacatacgcaaaccccggtaccgggataatgcacgtcctcgaaacacaccaagaaacaaaacaaacacacaccacaacacaacaaagag

SEQ ID NO: 375794 - DNA, 840 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaacaaaaaaaaaaaaaacaaaaaaaaaaaaaaaaaaaaaaaaaaaagggggggggggggcataaaataattccccgggggggggcaatttgggcccctttttttagaaaaaggggggcccacataatgaggggggagcgtatattaaaaacacagaagcggcgggcgcgggttaaacaacacgctggtggagagaaaaatggttgcaggcgatttaggaagaaaacccatttcgggggggggaatatgggaccacaactagaaatatacgtgaggagaaaatactaggagagagtggacccgtattttcgggaaactgtaggtatagtaattag

SEQ ID NO: 375795 - DNA, 913 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaacaaaaaaaaaaaaaacaaaaaaaaaaaaaggggggggcggcaaaaaaaaaattcccccggggggccccaaatcggcgccccccgttttttgggcacaaggggccccccaaaaggggaccgccgaaaataaacaagccagaccaccaggggggagcgggtttatacacacgcgctggcggccgtgggaaacactcgtcactgctgtgacgaacattcgtggagaacagcgaccccatactcgcgggcgggggggcccaatttggtggcacacttctctccatacgaagaattataaaccctctagcggaagaattaaaacctttagctgttttatgggttgacaaccaacgccgatattgtgtcggcgagtaagagttgtgtccacgaaatagtttgaaatttcag

SEQ ID NO: 375796 - DNA, 721 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaatctggtcaagtggagatttttaagaacttcctttttaagttgtaaaccttttattacaaatttaacacatgaagttcttaaaaatctcaattgaccagattatgacacagtttaacaacttcatttgtaattctgtactaacaagtttacaacctggattttttgcacaccaagtcaacaaatctgcaagccacctgttaatacggtcttaac

SEQ ID NO: 375797 - DNA, 698 bp, Homo sapiens
  misc_feature (18)..(18): n is a, c, g, or t
  misc_feature (510)..(510): n is a, c, g, or t
  misc_feature (525)..(525): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaaanaaaaaaaaaaaaaanaaaaaaaagaaacaaaagaaaaccccggagcgacacaaagagagagacgacgcacacaaagaggaacaaagacgcggcaaatagaaaacaagagaccacgacacacaaatctatagcaacaaagggggagaaaccgcggggaacccataaaggggacacaaaaaacgcgaaag

SEQ ID NO: 375798 - DNA, 730 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaaaaaaaaaaaaaaaaaaacaaaaaaaaaaaaaacaaaaaaaaaaaaacccgcgagagagcctatctattggcgcggggcgggagaaaaaagagaggacaagaaaggggcgaagagggcgccaaagggtggtccccggagaccccattttctttgggcacaaggggggaaaacttcggcggggccccccaaaaagagagggcgtaatattccgaaaaccccggggaaacccggttaaggt

SEQ ID NO: 375799 - DNA, 531 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaaaaaaagtcgacgcggccgcgaatttagtagtagtaggcggccgc

SEQ ID NO: 375800 - DNA, 655 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaatgtcgacccctttggccacattaatttagactccgccaaggctaaccaaggcggcccatttccacaaaacttgtttcgcccaattttgggcggggcccaaatacgggccattgtgccaatgccctattggggaacctttcaatccccggccgagttttcggccgcccggc

SEQ ID NO: 375801 - DNA, 663 bp, Homo sapiens
  misc_feature (18)..(18): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaactaccactctacctctcttttctctcctcacacctctatcatcccttccccctcaatccaccatcctggggttttacacaattcccctaatcataacaattgttgtctccctctggccacccttattttacctccgccactctttcctttgggccgccatttggggcctttctgctcc

SEQ ID NO: 375802 - DNA, 845 bp, Homo sapiens
  misc_feature (18)..(18): n is a, c, g, or t
  misc_feature (508)..(508): n is a, c, g, or t
  misc_feature (673)..(673): n is a, c, g, or t
  misc_feature (833)..(833): n is a, c, g, or t
aattcgcggccgacacgnctgcgagaagacgacagaaggggggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaagaagcagcagcggaaggagcggntgtacccgctgcggaagtacgcggcaaggcctgaggggcgcattgtcaataaagcacagctggctgagaaaacaaaaactacacgacacatacaaacaccaactaatccctccatatatatcaacccaaacaccaaacctgttggggggggcccggccaaaaagntttacacacatttttggcggggccgcccatgtatgatgatcgtctcactgtgtccagaaacgtcggcctgaacggggtgtggttccacaaaaaaacggggggccggcgtgaaaaacaggggtgggctttgctccacgcccgctaccccccgcgcgtcggntaattcgctgat

SEQ ID NO: 375803 - DNA, 1028 bp, Homo sapiens
tactactaaattcgcggcccgtcgacgcggcgttggcggcttgtgcagcaatggtgagagctgcggaatcgggcgccatccgagcgctgtgaggcgcgggggttggggaaggcggtgcgggctgagcccgcggattctatctgccacctaggcctgtggggcgccgcgcagaatggtctggcgccaccacaacccgcctcttcgcttggcgccgggagaggcgcgcggcccgggcctgggttactctgcccaaggcacggccggcgagggagactgtcctgagccctggttggggctccggcgcactcgtagtcgatggcgagtcgcgcgcctttgggggctggccacgcaggtgaaggggatatggccccgcggcctggctgaggcacactctctcttgcgcgcaggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaaaccaaacccaacacaacaacaagcaagaaacaaacacccagagtcaatagaggccgagcaagctttcatgggcggatcaagctcttgtgcaatcgccttgggagcgatacaatcagtgcgagtacaacgtcggactggaacctgggtacaataacgctgcagaatccctttgcgcgggtatcaaaggcgagaggccttcaagttgcactaagaa

SEQ ID NO: 375804 - DNA, 460 bp, Homo sapiens
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggactaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagaaaa

SEQ ID NO: 375805 - DNA, 873 bp, Homo sapiens
  misc_feature (536)..(536): n is a, c, g, or t
  misc_feature (701)..(701): n is a, c, g, or t
  misc_feature (861)..(861): n is a, c, g, or t
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaagggcaagaagtccaagcccctgacctgagtgtttcttctgagtccggaaatccattggcccgtgttctcacagttattaaccagactcagaaagaaaacctcaggaaattctacaagggcaagaagtacaagcccctggacctgcggctaagaagacacgtgccagtggccgcgggttcaacaagcacgagggagaacctgaagaccaagaagcagcagcggaaggagcggntgtacccgctgcggaagtacgcggcaaggcctgaggggcgcattgtcaataaagcacagctggctgagaaaacaaaaactacacgacacatacaaacaccaactaatccctccatatatatcaacccaaacaccaaacctgttggggggggcccggccaaaaagntttacacacatttttggcggggccgcccatgtatgatgatcgtctcactgtgtccagaaacgtcggcctgaacggggtgtggttccacaaaaaaacggggggccggcgtgaaaaacaggggtgggctttgctccacgcccgctaccccccgcgcgtcggntaattcgctgat

SEQ ID NO: 375806 - DNA, 1066 bp, Homo sapiens
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagtaagaagacacgtgccatgcgccgccgggtcaacaagccaccgagggagaacctggagaaccaagaagcagacagacggaaggagacggggtgtgacccgcgtgtgcggggagtgatacgccgggtaagggcctgagggggcgcaattggtcaattaaaggcaccagctgggcttgagaaaacaaaaacacaacaaaaacaacacacaaagtcacaaacaaactaacaaaaaacaaccaaacaaaaaaaaaaccaaaacccgcggccgagacctaccctacaagcgacggggcaacaacaagaaagagagctgacacgagaaagcgcgccgacccgcggcgaaccagatgacgagctgcggcacagacccacacatgcttgcttctggacgacccacgggtgctcaaacaacaagccgggcctccaccaatcatagtggagtgaggcgacgaatgatatgacccgataatgcaccgaggagtaccagcccgagtatagaataagagggggcggcgcacaagcccacagccgacgccgacgacccggcatcaccgaccgagcgccaggcaaagcgagaggaccctacagacgcacacacacaaaccgatgccagacggacgaagacaacacacgcagaagccacgacacgcgaagctcagtcatgcaccacacctacgtgagcacacgaccactcactatggtaagtcaccacgcgggccaagctatgtctacacgatcaacgcagcaagacgccaccgacatcaacacaggacactacccgacaatagctaccagg

SEQ ID NO: 375807 - DNA, 672 bp, Homo sapiens
ctcaaggatccttaattatattaatcccccccccccccccccccccgctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatgtaagtgaggcggccggatcacagccctcgtgggtggggagcacgtgtgcatcgggatcgtcggaggatttcaaagttggcttaaggagctggccgcttagatgcccactccgtgcatcctggcgcgcatgggagacccgttgtgtgcttagcctcttacctgccttgaccttgcggtccttgtgcctggaatgcatccccggagacccatcttaatgctgccttcaaagcctacccggaccccttccttccgcttcccaccaacacttgagtttttaacccccttggcaggtgggtggcttgcaccctggagtggcagcgtaagttattttacatggctaagagtgcgggagacttgtgaaaggaacatgggtttggagttcatcaacctgggtacaaagtccacttctcaaaaaaaaattagatgggtgtggtggtac

SEQ ID NO: 375808 - DNA, 1871 bp, Homo sapiens
ccagcatcccacgggtataagatggccagaggcggctgcctgctgctctgcaggtaccatggagctgagctataggctcttcatctgcctcctgctctggggtagtactgagctgtgctacccccaacccctctggctcttgcagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaagaaagcaatatctggtcgtggtgtggtggtcaggtggaaggtcagaattagtactgactgtgtcgggtggggacgactgtataccacccgccccgtgcactcacatagcatagtccagcaagcactactgtgtctctactgtaaacagggcagggttcatgtccttagacaactataatctatcacctccatgggaaccaacatggaaactcttagatgaaggtcagtctggctggacccaccttacttctaggctagcaaagaatcttatatctctggcccccatggatttgactctagacatgggagtggggaggagagagcttccaggcccacttctccaaggcaagcaggcaggcagctctgtccagatgctagaggccagaaggccagtcatgactgggccctcccagtagggcagtgatcagagcactgcttctgcctggtcttagctgtcaccttgggcttgaagctattcttgggacatgttggtatgaacttgtcaaagctgcagcaaggggtgactgg

SEQ ID NO: 375809 - DNA, 701 bp, Homo sapiens
  misc_feature (588)..(588): n is a, c, g, or t
  misc_feature (701)..(701): n is a, c, g, or t
ctctgcgtctgatggaggagaagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgtgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgttgtgacagaagaacctaatgggccagcgaggctcctgancttcttgtaaggagggggagcactgattccacacttggctctgccttcgacccttatggcgctgtggacgttgcatggatgtggcgatgacctatttagcccgagatttaatn

SEQ ID NO: 375810 - DNA, 684 bp, Homo sapiens
ctctgcgtctgatggaggagaagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtctcgtctacggtctcattgatgcctcttacgcatttaaagctcctcgacccgcgccgatccactcccttcacagcgtatgtcctccacttccctaacgactcccgaatcatgataccactcccctgcccactgaaggccactttttctgtgcctgcacctagatgacctacccaaggcccttgttctctcctacgcctttcaccatgtcgttcccctgtgaagagtcgttgacaccctcttatgctttaacaacgcgtccgggacatcctcgaccataccataagcgatcttttgcaccagcccatgcattacattggttcctttatccgcggcttgtgcgtaaccagcttctctccccgtgtgtcacttttcccctggacaagccgttcaaccggatctaaccaccgcttttatcatactaactaatcgatgcgcttggacgtccaggcaggatgcggaatttccgcatactttctctct

SEQ ID NO: 375811 - DNA, 400 bp, Homo sapiens
ccagcatcccacgggtataagatggccagaggcggctgcctgctgctctgcaggtaccatggagctgagctataggctcttcatctgcctcctgctctggggtagtactgagctgtgctacccccaacccctctggctcttgcagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggctagaatgcaatggcacgatctccgctca

SEQ ID NO: 375812 - DNA, 1558 bp, Homo sapiens
tcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagggataatgcggcgtttccttaaggagggttatttatgatcctcgttactgactcctgcctctggtttatggtggggaaactgttttacttactcaagggggt

SEQ ID NO: 375813 - DNA, 1155 bp, Homo sapiens
aaaggaacataatttttagggttcccccagcgcccccctcggcgaattacggccccgggcacagccgaagaccccaggtggcctctagtgtccaaacaaggtcccacgcggcgcatggaccgccagcctcctccccccggtgcccctggcccccgggtttcaaggacaactcactttctccgcctctgatgaggagaacggaccctcaaaaagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375814 - DNA, 1110 bp, Homo sapiens
  misc_feature (1)..(1): n is a, c, g, or t
ncggggggtaggagatagtatgtggtcttttatttatctacaagtttctacagttctgtgggagagggatataataaaaatgttaactaccccacaaggtcactctccaatattattgcagacggactctctagcgattcgcatggttttatttgggtttgatgcacaagattgaatcactgagagatggtctcccccctcccatttgatagaatcagctcacctgctgaagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375815 - DNA, 1096 bp, Homo sapiens
tgggcgaaggagcaaggtatcagtgtgagctttcagctgcccaaaaagggatcacaggcggcgaatgtaacagcaggccttctgcccagctggtgccgttaggacccggtgttctaaaggagaagtgcacttctttttgcgtctgaggaggaagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375816 - DNA, 1076 bp, Homo sapiens
cttctcctctccaaaaaagggatccccgccggtcaattggcaaccaggccaccttgccccctgtgggcccttcgggaccatggtgttctaaaaaaaaagcgtcctccctctttgcgtggagaggagaaagccagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375817 - DNA, 1058 bp, Homo sapiens
ttcaattcccaaaaggatacctcggcgggggtagggagagcgagcattcccgcccctggtgcccttcgggccaggtgttttagaagaaagactacttctttctgtgttgaggagagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375818 - DNA, 1587 bp, Homo sapiens
ggttggcgcggggccacgcccccgggcgggttcaaccgcctcccgcgcccttgggtcacactgcgaccgtctgtccccactcctctctcgaccctccggaggcttccccacggatcgtggactttaccagatcggtttgtaatacacgtcagagacgctatccgatccatcaggcccagtattcctgtctgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaagaaagcaatatctggtcgtggtgtggtggtcaggtggaaggtcagaattagtactgactgtgtcgggtggggacgactgtataccacccgccccgtgcactcacatagcatagtccagcaagcactactgtgtctctactgtaaacagggcagggttcatgtccttagacaactataatctatcacctccatgggaaccaacatggaaactcttagatgaaggtcagtctggctggacccaccttacttctaggctagcaaagaatcttatatctctggcccccatggatttgactctagacatgggagtggggaggagagagcttccaggcccacttctccaaggcaagcaggcaggcagctctgtccagatgctagaggccagaaggccagtcatgactgggccctcccagtagggcagtgatcagagcactgcttctgcctggtcttagctgtcaccttgggcttgaagctattcttgggacatgttggtatgaacttgtcaaagctgcagcaaggggtgactgg

SEQ ID NO: 375819 - DNA, 1497 bp, Homo sapiens
ctcttgccgtctcctccccgcgcgtcctatagactatccactcggaactctgaatacttcatacaacacccttctttctcgctccgcccgcacacgccactcgcagctggctgcgcgacagccacccataccggccagacgcctggctctatcggtcagcggcgtcgcacgcccacgcccctattccttgtctcctatcaaacacccctcccgcacacagcaaggtcccgccgcctcccccccggcaaaccgagccacccactatgctgctaatccaccacggcaggccccggccctcctcggttcgcttgggacccctgtgggcccgacccgacacaaaaccaacaggcccccccttttccccccactatggacttccaaggcggttctggtagccctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaagaaagcaatatctggtcgtggtgtggtggtcaggtggaaggtcagaattagtactgactgtgtcgggtggggacgactgtataccacccgccccgtgcactcacatagcatagtccagcaagcactactgtgtctctactgtaaacagggcagggttcatgtccttagacaactataatctatcacctccatgggaaccaacatggaaactcttagatgaaggtcagtctggctggacccaccttacttctaggctagcaaagaatcttatatctctggcccccatggatttgactctagacatgggagtggggaggagagagcttccaggcccacttctccaaggcaagcaggcaggcagctctgtccagatgctagaggccagaaggccagtcatgactgggccctcccagtagggcagtgatcagagcactgcttctgcctggtcttagctgtcaccttgggcttgaagctattcttgggacatgttggtatgaacttgtcaaagctgcagcaaggggtgactgg

SEQ ID NO: 375820 - DNA, 1398 bp, Homo sapiens
agtaatagaagggcttaccactacgggaggtgagcaccagcgccacatgccagcttggatcccgtgcgagcacgcggtattctgaagaaactttactatttttttgggctttgaggggggagtatgttaacccatagaacgctccccgcacgctcctctttgggcgatccagcccaccgctagtgcgaagtcccccttgcaatcatgtaccttgcggctgtttgtggaccataggaggggcacacctacccgaggcaagaatgcccccccttataacaccatgtggggaattccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaagaaagcaatatctggtcgtggtgtggtggtcaggtggaaggtcagaattagtactgactgtgtcgggtggggacgactgtataccacccgccccgtgcactcacatagcatagtccagcaagcactactgtgtctctactgtaaacagggcagggttcatgtccttagacaactataatctatcacctccatgggaaccaacatggaaactcttagatgaaggtcagtctggctggacccaccttacttctaggctagcaaagaatcttatatctctggcccccatggatttgactctagacatgggagtggggaggagagagcttccaggcccacttctccaaggcaagcaggcaggcagctctgtccagatgctagaggccagaaggccagtcatgactgggccctcccagtagggcagtgatcagagcactgcttctgcctggtcttagctgtcaccttgggcttgaagctattcttgggacatgttggtatgaacttgtcaaagctgcagcaaggggtgactgg

SEQ ID NO: 375821 - DNA, 1264 bp, Homo sapiens
cccttctcctggaaactgcggaatccttacaagcagagattacagtggcagcacggaccattctgtggatgtaaccattgattgaccaccgtgacaccagaccagaatgcttccccttacaatcccatcatgtacttccatgatgttctggttgacgatatcggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaagaaagcaatatctggtcgtggtgtggtggtcaggtggaaggtcagaattagtactgactgtgtcgggtggggacgactgtataccacccgccccgtgcactcacatagcatagtccagcaagcactactgtgtctctactgtaaacagggcagggttcatgtccttagacaactataatctatcacctccatgggaaccaacatggaaactcttagatgaaggtcagtctggctggacccaccttacttctaggctagcaaagaatcttatatctctggcccccatggatttgactctagacatgggagtggggaggagagagcttccaggcccacttctccaaggcaagcaggcaggcagctctgtccagatgctagaggccagaaggccagtcatgactgggccctcccagtagggcagtgatcagagcactgcttctgcctggtcttagctgtcaccttgggcttgaagctattcttgggacatgttggtatgaacttgtcaaagctgcagcaaggggtgactgg

SEQ ID NO: 375822 - DNA, 1331 bp, Homo sapiens
  misc_feature (1237)..(1237): n is a, c, g, or t
  misc_feature (1241)..(1241): n is a, c, g, or t
  misc_feature (1246)..(1246): n is a, c, g, or t
  misc_feature (1249)..(1249): n is a, c, g, or t
  misc_feature (1254)..(1254): n is a, c, g, or t
  misc_feature (1258)..(1258): n is a, c, g, or t
  misc_feature (1264)..(1265): n is a, c, g, or t
tcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgtnacanaagancanatgtnccgnggggcnntgacttctggacaggggggtgaccttgagtaaccagtggctttgcctttgacactagggggctgtg

SEQ ID NO: 375823 - DNA, 1351 bp, Homo sapiens
tcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgcgcagctttgacaaagaatcaatgtcaccggggaccctgatcttctggaaagatggtgacagaataaaccatggcttgctttgaacctacagtctttgggctagccgctgaggggttt

SEQ ID NO: 375824 - DNA, 1436 bp, Homo sapiens
tcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgtgatatacatcacctgccacctgaaggtcaccctagctgagcaggacccagatgaactcaacaaggcctgttccttcagcaagccttccaacagtgtttcccagtgtaaggctaggtttacatttggcaatggttttgcaaaggggactgtggcactgctagccatgcagtaggcggcctaatgactgagagcaatggaccagcgtcgttcccgaaaccgggggcatgtgcatgatatacaaggtttcccgagagcctcattcattctgacagcaggcgaacccgtaagcaaacaggtgctttccgctggacatctttattggtactctggctaaatcgccctttgtgcggacgcttccataacagtttccttctctgtgagacaaaggaacccgacgccggcgcccttgcctaagtgttatcaacaactct

SEQ ID NO: 375825 - DNA, 1263 bp, Homo sapiens
tcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgtgatatacatcacctgccacctgaaggtcaccctagctgagcaggacccagatgaactcaacaaggcctgttccttcagcaagccttccaacagcttgtttccagtagaaggatagggtcacatctcgttatgctgcacataagctactgtggttcttcagactttgcggaggcaccttctgtattagccactgtcacgtttttttcccttataatggcgacgcgcaaaaatagatgtctctcttggtctttgctctta

SEQ ID NO: 375826 - DNA, 1259 bp, Homo sapiens
tcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgtatttacttacctgccccccgaaggtacccctatcttacctatgattatagtacctcaacatgcccgatccttcaatagccttccaacatttgttcccggtgcaggctctgctgcatcatgaaatgcgcccctaaggtgaatgaagcctcaaactattacataaagatcgtctcgtttacacctagtacctctttatttttgactcgatacgagtataaatacagatttaccttttgtaccgcgcttgtcctacg

SEQ ID NO: 375827 - DNA, 1153 bp, Homo sapiens
cacccgacgctccgtcaagcgccgtatcaccactgctcaccagagcggcgcatgacatgcttcatgaacaacccggctacaatcacggacgcggatgacggccccacaagggctctctatcgacgcacactgggatactaccctgcttacaccactctcccgctgcagacctcacgcgccacaacgtgaacatcacctctcacacactctccggcaacccggactcctacggagagggacccccgcatacgggtgaggcacgtaagcatcctcagccaagaagccacacgggaacccgcgggcctcacagtcaattttgatacgcagtgtgcgcaaaccgcacgcggcccagaagcccccccttatcacaccatcgagcccctccagcgcgttcatgtcaacggactaatagaagcctccgggcataccaagttcttagacccggtcccgatacattccagttcccagtggaagtcctccctctgataatgatcccagtaacctgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375828 - DNA, 1063 bp, Homo sapiens
agggtgatgaggtgttgccacattggaccacgaactatgtctgcacaacgtacctactgctgacgatggcagcactcgctgcggaacatcactctactctgtgtcttgctgaccgagcaagtgttgcccgtaagcttcggtgtcttaacttcaccaatcgattaacagttagctttctggctgccattcagctattctttcatcccacccttaggtatactgtaggtacatatcgggccaaaacggcgtgttggcaagcaaagtctcccccttgcaaaccactgggagaattaatctgtttgtcttctccgtgtcaacttgaggcgttttatgctatgaaattctttgatcccggactagatatttcctagttctaaggggagttcttcaactctataatggttccagacgcatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375829 - DNA, 1039 bp, Homo sapiens
cctgcgccatatcagtgccatcgcgcttatatcaaaccggatccagccggccacactttgcgggtcgcgacattatgcgtgacactatgggctttcttttaagatctcggaaagaaaactcacactataggaatcccccccccccacataaaaggaggggccctcgcgatcgtgactgcaagaaaaaaacggcacacccaacatgtttgacacctgggtggcaatgggtccatgcctcaatgctcctctgttctcactatataatcttccatgacgttatagatttgagtctcaaggagcctgttcgggaattaaaaatcctggacccgggcctggtcacccctgtttccaagtggagttttcccctctgccagtgggtccagtaaaaatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375830 - DNA, 1087 bp, Homo sapiens
  misc_feature (79)..(79): n is a, c, g, or t
accggggcgcggaagtgacaacacaggccttccccccatattgggcaccacgagatgctagggatgaaagaagaaaggnaaatatccctcagggacgaaacaccgccgggcacgggtgaacagagccatccacctcccccggggcggagcatgccctccacagggtaaatcacccccggcgcccataggcacacggagagtgatttgcgccccacctggtggccagcccggcaaccaggacaagaaagccccccctttatcaaaccacgggaacttccaagggctttttatacgcgggtttcacagacggcctatttgcgaattaaaagttcccggacccgggccaagaaccatccagtttccaggggaagttttccccttgtgttaatgaccccaaaaacctgatatacatcacctgccacctgaaggtcaccctagctgagcaggacccagatgaactcaacaaggcctgttccttcagcaagccttccaacaggcaacaaaaatctaagctgcttctctttcatctcactggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375831 - DNA, 1099 bp, Homo sapiens
tccacgttccatcacagtgctcccttgccggcacactttcgagctcacacacatccgcgtccttgtaggactgactggccctcttcattcctactgacactcagctttccttagcatagtgttctggacttcataactgacgctcacttaataagattgccctattcttcacactcttactattcctcgaaatttccggttcgctatcctcgcaccacagccatatctaccctccccgttctacttcggcactcattggtggctacacctctgctctcactgcccacgtgcccaccctctcaccccccctcgggatcttcccatgcctgtcacgacgtcggttataatgaacagctttcctcacagtccccagttccgtcaccacggcgcgcaatccccactggtgtatagatgaattgctacacatttgtttttgactcccctgacgatcgtttgtttcaccagcccgtgacaggtaaccctagttgagcaggccccggacgaatttaaaaaagcttgttctttaggcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375832 - DNA, 1047 bp, Homo sapiens
  misc_feature (1)..(1): n is a, c, g, or t
  misc_feature (71)..(71): n is a, c, g, or t
  misc_feature (102)..(102): n is a, c, g, or t
ntttcttcgggtgttcaccagaggccccccgcggtttaatttcaggccaccaggcacaagctacaaggatncaggttgacctttcactttcacacaaaaggntccccaggcatggccagtgtaccatccggccatctccgccccctggtgccctttaggacccccggtgtttagaagagaagtcacttctctctttggttttgatggaggagaactggaacgctgagaagaggtcccccaccttccacctgggagatgcaaaatccacactggcagccacgtgccactgcggttgtttgtggaccactgcgtggccacaccgacaccagaccagaatgcctcccctctgtcttgtcgacggtctcactgatgcctcttctgcattcaaagttcctcgacccgggccagatacactccagttctgatatacatcacctgccacctgaaggtcaccctagctgagcaggacccagatgaactcaacaaggcctctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375833 - DNA, 1175 bp, Homo sapiens
gcaaacagtgctgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaagaaagcaatatctggtcgtggtgtggtggtcaggtggaaggtcagaattagtactgactgtgtcgggtggggacgactgtataccacccgccccgtgcactcacatagcatagtccagcaagcactactgtgtctctactgtaaacagggcagggttcatgtccttagacaactataatctatcacctccatgggaaccaacatggaaactcttagatgaaggtcagtctggctggacccaccttacttctaggctagcaaagaatcttatatctctggcccccatggatttgactctagacatgggagtggggaggagagagcttccaggcccacttctccaaggcaagcaggcaggcagctctgtccagatgctagaggccagaaggccagtcatgactgggccctcccagtagggcagtgatcagagcactgcttctgcctggtcttagctgtcaccttgggcttgaagctattcttgggacatgttggtatgaacttgtcaaagctgcagcaaggggtgactgg

SEQ ID NO: 375834 - DNA, 1358 bp, Homo sapiens
ggttggcgcggggccacgcccccgggcgggttcaaccgcctcccgcgcccttgggtcacactgcgaccgtctgtccccactcctctctcgaccctccggaggcttccccacggatcgtggactttaccagatcggtttgtaatacacgtcagagacgctatccgatccatcaggcccagtattcctgtctgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaagaaagcaatatctggtcgtggtgtggtggtcaggtggaaggtcagaattagtactgactgtgtcgggtggggacgactgtataccacccgccccgtgcactcacatagcatagtccagcaagcactactgtgtctctactgtaaacagggcagggttcatgtccttagacaactataatctatcacctccatgggaaccaacatggaaactcttagatgaaggtcagtctggctggacccaccttacttctaggctagcaaagaatcttatatctctggcccccatggatttgactctagacatgggagtggggaggagagagcttccaggcccacttctccaaggcaagcaggcaggcagctctgtccagatgctagaggccagaaggccagtcatgactgggccctcccagtagggcagtgatcagagcactgcttctgcctggtcttagctgtcaccttgggcttgaagctattcttgggacatgttggtatgaacttgtcaaagctgcagcaaggggtgactgg

SEQ ID NO: 375835 - DNA, 523 bp, Homo sapiens
tcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgcgttggcccaacggccaacgcaccgtgtcgtgtagtacgatgtctagtgatgagttggctaatacaatgccagtcaggccacctacggtgaaaagaaagatgaatcctagggctcagagcactgcagcagatcatttcatacggtgcgttggcccaacgttgggccaacgcaccgtcggaaatggtgaagggagactcgaagtactctgaggcttgtaggagggtaaaatagagacccagtaaaattgtaataagcagtgcttgaattatttggtttcggtagataactattagactatggtgagct

SEQ ID NO: 375836 - DNA, 150 bp, Homo sapiens
acctgccacctgaaggtcaccctagctgagcaggacccagatgaactcaacaaggcctgttccttcagcaagccttccaacaggtgaggaggacaggtgctccgtgactggagtagaaactgaatcggcgaccccttgtctatttccccc

SEQ ID NO: 375837 - DNA, 1054 bp, Homo sapiens
aaggcacctcctcttcgagggtctccaccaaggccacagccaggccaaattagtgtcacagggaaaaactacacgacccagtttggccgtccatgtcactgaaacggtcccccgcaggccaaggacgcaccaggccctccgccccctggtccctccagcccacgtttctaaaggaaacctacttctcctcgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagggataatgcggcgtttccttaaggagggttatttatgatcctcgttactgactcctgcctctggtttatggtggggaaactgttttacttactcaagggggt

SEQ ID NO: 375838 - DNA, 712 bp, Homo sapiens
  misc_feature (712)..(712): n is a, c, g, or t
ctctgcgtctgatggaggagaagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgtgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcgctctttgtattgacccaatgggttcagtttttcttctcgtatcccggaggacatgttataaaagaactcatctttcaccggtgaggcccctcttttttcgtgtatatgcagggtggcccactcacatgagatcagggggctttctctcttgacaccctcagtgtgctactcggaacaggcccatctgtagcggtataccttataatggatggtn

SEQ ID NO: 375839 - DNA, 1652 bp, Homo sapiens
tcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375840 - DNA, 1154 bp, Homo sapiens
  misc_feature (1)..(1): n is a, c, g, or t
  misc_feature (71)..(71): n is a, c, g, or t
  misc_feature (102)..(102): n is a, c, g, or t
ntttcttcgggtgttcaccagaggccccccgcggtttaatttcaggccaccaggcacaagctacaaggatncaggttgacctttcactttcacacaaaaggntccccaggcatggccagtgtaccatccggccatctccgccccctggtgccctttaggacccccggtgtttagaagagaagtcacttctctctttggttttgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375841 - DNA, 1130 bp, Homo sapiens
  misc_feature (94)..(94): n is a, c, g, or t
cctcatctagtacccccacgatacaacgttcgcacacaggtaagttacgcgcaaacgatccgccctctcgcttccaacaaagtaccctggaagnctttgggagacctggcctcctgccaccggtctggcctttaggtcgtggggtcaacaagcacaacataacttctccttgcgtcgcaggaggacagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375842 - DNA, 1079 bp, Homo sapiens
ctttctcaaaaaggtccccggcaggaaatgtgggggcaggcattttgcgcccgtgtgtcccttaggaccgcggtttctccaaaggaaaggcggtattcttctggttttaagagggtaaactgctacaggaagaaaagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375843 - DNA, 1079 bp, Homo sapiens
aaatttttgcattacggacgacctttagctgtcgaaaaaggaccaccacagtgacagctccaccagagtccttcgccacctgttgcctataagcccggggtttccaaagcaagaacccttcttttagtgcgaagggaaaaataagcacctaacaagaagccaccccctctccacattggaaaacagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375844 - DNA, 965 bp, Homo sapiens
ctctgcgtctgatggaggagaagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375845 - DNA, 1397 bp, Homo sapiens
ctttgacaggtgtttacgcatgtaaatgaacgccagccaaactgccaccaggagctataagaaatggtttctttaaggacatcacttttttttggttaatggaggacaaatgagagtaagaagtggacccaccttaccactgggacgtacgcacactttcaagcagaaattatccttgtaggtacgtcacatgcggatgattgtggacccttgggtggcaacacggcactaggccagaaagcttcccaatattcaacgaatgtggaacttccatggatgtttggaaagggtttcaaactgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaagaaagcaatatctggtcgtggtgtggtggtcaggtggaaggtcagaattagtactgactgtgtcgggtggggacgactgtataccacccgccccgtgcactcacatagcatagtccagcaagcactactgtgtctctactgtaaacagggcagggttcatgtccttagacaactataatctatcacctccatgggaaccaacatggaaactcttagatgaaggtcagtctggctggacccaccttacttctaggctagcaaagaatcttatatctctggcccccatggatttgactctagacatgggagtggggaggagagagcttccaggcccacttctccaaggcaagcaggcaggcagctctgtccagatgctagaggccagaaggccagtcatgactgggccctcccagtagggcagtgatcagagcactgcttctgcctggtcttagctgtcaccttgggcttgaagctattcttgggacatgttggtatgaacttgtcaaagctgcagcaaggggtgactgg

SEQ ID NO: 375846 - DNA, 1371 bp, Homo sapiens
ccgtaaaggacaccgcgcgggggagtataaagcaaaacgattctggggcgcgaaatcctgatggcaacggggttatacaggagaaggcattttcctttgtgtttaccaagcggacaggatctcaacaaatagtcccaccctcccccttgaaaaataaagccgcctccggggcgaatccacagcgagagcacaaacccctgggttgtatgtggacaccagggggcccccaccgtcgccagaccgaatgcccccccttatcgcaccatagggactgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaagaaagcaatatctggtcgtggtgtggtggtcaggtggaaggtcagaattagtactgactgtgtcgggtggggacgactgtataccacccgccccgtgcactcacatagcatagtccagcaagcactactgtgtctctactgtaaacagggcagggttcatgtccttagacaactataatctatcacctccatgggaaccaacatggaaactcttagatgaaggtcagtctggctggacccaccttacttctaggctagcaaagaatcttatatctctggcccccatggatttgactctagacatgggagtggggaggagagagcttccaggcccacttctccaaggcaagcaggcaggcagctctgtccagatgctagaggccagaaggccagtcatgactgggccctcccagtagggcagtgatcagagcactgcttctgcctggtcttagctgtcaccttgggcttgaagctattcttgggacatgttggtatgaacttgtcaaagctgcagcaaggggtgactgg

SEQ ID NO: 375847 - DNA, 1249 bp, Homo sapiens
caaccacacaggaaaatacagcacacctccaggcgaggagaccaccacttgcagccaaggaccatgcaggatgtgtgaggaccattgtggcgccacgcttacactggccaagaagcctccccgtagcacgccatagtggactcacaggactgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaagaaagcaatatctggtcgtggtgtggtggtcaggtggaaggtcagaattagtactgactgtgtcgggtggggacgactgtataccacccgccccgtgcactcacatagcatagtccagcaagcactactgtgtctctactgtaaacagggcagggttcatgtccttagacaactataatctatcacctccatgggaaccaacatggaaactcttagatgaaggtcagtctggctggacccaccttacttctaggctagcaaagaatcttatatctctggcccccatggatttgactctagacatgggagtggggaggagagagcttccaggcccacttctccaaggcaagcaggcaggcagctctgtccagatgctagaggccagaaggccagtcatgactgggccctcccagtagggcagtgatcagagcactgcttctgcctggtcttagctgtcaccttgggcttgaagctattcttgggacatgttggtatgaacttgtcaaagctgcagcaaggggtgactgg

SEQ ID NO: 375848 - DNA, 1246 bp, Homo sapiens
tcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagcttgtttccacgtgaaacgctcggcttgacatcttgccatgctgcaaccaaagtgacttggggtctcccagcccattctagatggtatcttgctcgcttggatcactcgttcatctttttcttcccgtaccccccgccttggcaccaaag

SEQ ID NO: 375849 - DNA, 1033 bp, Homo sapiens
  misc_feature (34)..(34): n is a, c, g, or t
  misc_feature (38)..(38): n is a, c, g, or t
  misc_feature (40)..(40): n is a, c, g, or t
  misc_feature (48)..(48): n is a, c, g, or t
cgttgcctcaggccccgggtttagagagaagggncttntnttgggttnaggagaagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacaggcaacaaaaatctaagctgcttctctttcatctcactggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375850 - DNA, 1318 bp, Homo sapiens
  misc_feature (1227)..(1227): n is a, c, g, or t
tcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgcgatacttgatatgactagcctgccacctgaatgtgaagcctagcttacgccgaccctaatgaactgataaagggcttgtagcttaagcgaacccttcgaccagtttggtcgcccacgggtacggcctctaactggaatgtgttacttccctgtcactacatttccctcgtagcctctcataactctttctatatatggcagcctcgccgtcctcatcctttngttgactaagccactttctccctctcagctacgtctccgtaccattgaacccctgtcacacacataattatcttgatgtttcagcgcaagg

SEQ ID NO: 375851 - DNA, 1083 bp, Homo sapiens
gaaacaaaggttattgcggacaaatacaaattctgcgtcgcggcaactacacctcaaactttaatcgatctgtgttgaataacggcacgagaaagaccggtctaaactctcctagtcttatggtctggtcttacttcctcatatgacgccgcgacaagatgtcctacaatggtttaagcaggaaggggggggggcgcgggtgtgtacgaaggagcggtgagatggacacgccgtacatggttaattcccgatgaagcctgattcgatggaagtacaggaaagtacccgtatattatcgatgtggatttgctaaggctgttatatcccacggttgtagaaagcattgttgggctttcatagtaaattgtctcaggcacaggaagcctccattttatacttgatgttttcaccttgaataagcgcccaggcgacataatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375852 - DNA, 1060 bp, Homo sapiens
ccttatcattacacggcaggataaaagagggcggggcgcgaacacgacgtgatcccagtggccgcattgggaacatggtgttctaaatgtcgcgaaatttcttttaatagtgacgggtactaataatccaataaaaggggcactatgtttcaacatctataggtggccacgtcaggatgagaatcaaagtatggtacttgcctcgcttcgtgtagatatggtaacgtggtagagagcgcacaatcaagtgaacaataaggctgccccttataagacagtgtgggatatgcaggatgtgatataggcgggtgctgggggaagcttatgggcattcaaagttattggactgagtcaagaaaaattcgagttcacagtgtattttctccggtttgggtaatactcccgaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375853 - DNA, 1028 bp, Homo sapiens
cttttgcgtcatctggtatcaaaataagtgttggcgtgacgatatcgaatctaaggttgcttaggaaaggggttaaagaagaggcacaattttttgagtaggaaacaagaatagggttcagaggggccccccctttcacaaggataacggccccttcgggatgcgttcacattacgtacctagtgccgtcggtgattagggacgatgtgttgcgcccggccacagacataaatgcttccccttaaacacagtggtgggattcacgcaggtcttttgagggtctcgtggagcctctttggcattgaaagttcttgattcgggccaaaagcactccagttcccaggtatgttctccactttgctattacttccagaaccatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375854 - DNA, 1066 bp, Homo sapiens
tacgcattcatagcgcgcacgttattactaccacgtctagttggccgatatacctactttccgacaggcactccctgcgaatacgaccccgcttgctggtatctcactttgcaatgctatcgtacattattcgtgctagcctcgcgacataaagtaaatagaggggtacgggtccgacgcttgctctttaggttacacaacggtttgtggcattcctagtttgcatgatggcgctcaaaggctcttaaaagcgcacgtcgtcactacctgcatctaccagaaattaccgaggatgcttgattatggatcatgcagggggctcgttgggaatcagaagctccacgtcccagggccacaaacatcttccctgttggcaggctaagtctttcctctatgacaacgctccccgaaccattgtatgcttttaccgtccacctaaaggtctccctaactgagcgggcccacatttacttctcaagtgcctgttccttcagcaagccttctctacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaaacagaaaaagaaacaaacgcaacacgagaaagaaacaagaagaaaaagggggggggtcaaaaaccccgggggcacaaatggacagccagtttgtaaaggggccataggggaaataaaacaagggggggaaaacaggggagggaaagccggggctggggacacctctggggggcaggacccaccagaaagcggga

SEQ ID NO: 375855 - DNA, 1241 bp, Homo sapiens
tcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttgcaacactcacgacccgcccggactgtgaggtatacggcctcacccgtgcccctctttgtatccaaacgccctcctcccacggccccgtactctcccccctcacaaccgacaccctccctcttccggctcgcgctcccaattcgctgttctcactcccctaccctcctgcagccaaccccatatgttcctggtcgtagctgcactccactccggccggatctctcactatcttttccactccccggtccacatagtatattttcgcaatcctccgcttagcccgccccgacactcccccctcctgcaaccattttgggcgtcgcgggcccttccctcttggcgccctcgcttacgttctgttttgactcattacacctac

SEQ ID NO: 375856 - DNA, 1461 bp, Homo sapiens
tcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaaaaaaagaagaaagcaatatctggtcgtggtgtggtggtcaggtggaaggtcagaattagtactgactgtgtcgggtggggacgactgtataccacccgccccgtgcactcacatagcatagtccagcaagcactactgtgtctctactgtaaacagggcagggttcatgtccttagacaactataatctatcacctccatgggaaccaacatggaaactcttagatgaaggtcagtctggctggacccaccttacttctaggctagcaaagaatcttatatctctggcccccatggatttgactctagacatgggagtggggaggagagagcttccaggcccacttctccaaggcaagcaggcaggcagctctgtccagatgctagaggccagaaggccagtcatgactgggccctcccagtagggcagtgatcagagcactgcttctgcctggtcttagctgtcaccttgggcttgaagctattcttgggacatgttggtatgaacttgtcaaagctgcagcaaggggtgactgg

SEQ ID NO: 375857 - DNA, 1443 bp, Homo sapiens
  misc_feature (1)..(1): n is a, c, g, or t
  misc_feature (5)..(7): n is a, c, g, or t
ngccnnngcccccgcgccggcggcggcgcggcgcccgcgcttccgtagcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctga

SEQ ID NO: 375858 - DNA, 1041 bp, Homo sapiens
  misc_feature (1)..(1): n is a, c, g, or t
  misc_feature (5)..(7): n is a, c, g, or t
ngccnnngcccccgcgccggcggcggcgcggcgcccgcgcttccgtagcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgc

SEQ ID NO: 375859 - DNA, 867 bp, Homo sapiens
gcacctgcgaccccaggacccctcccgggccctgtcctgcgccctccacgcgtcgcccctgctgggagtccgctttcgttgcacccctccgcgtcccaccccaccccaccaaggatgcccaggataccgggcatttgccactgcaagatatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgc

SEQ ID NO: 375860 - DNA, 671 bp, Homo sapiens
atatatttttaagtggaaaaagcaggcagaacagggaccgtacatattgttgttagtgtcagctcccaaatggatcttattttatctcagatcacagtccttgcaccatgtggctgctggcaccaatgtagagtaaaaaccatctatgtgggcattttttggcacaagaaaaatctcaatctgataccaataaatgtgtgttaaagaatgtcagacttagagtaatcattgcaagttgagcccagataaaactattgcctctctaatgtgttttcttccttctagtgtatatcagcctcgtgtttggtatttcatatgattcgcctggtaagagatgttttttggcttcactaaattttgtataagagtgaaagtgttggggcaaccattcagaggtataaaatgtgggagatttgatttctgattgtacatctgttgcctgttttattgggattctttctctgtaaaaggagctaaaatgagctaactctggttttttgagagatacaaaactagtctaagaaatgcagccctccagatcatggttatacctgtttctgtaatactccaagctcatttatcaatgctctcatatctgcagatcgagctcgtagcggtccgcctcatattctattctgcctcacaaaatctaacacgcgtacttacagccg

SEQ ID NO: 375861 - DNA, 4458 bp, Homo sapiens
  misc_feature (1)..(1): n is a, c, g, or t
  misc_feature (5)..(7): n is a, c, g, or t
ngccnnngcccccgcgccggcggcggcgcggcgcccgcgcttccgtagcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttgagacagagtctcgttctgtcgcccaagctggagcgcaatggtgtgatcttggctcactgcaacatccgcctcccgggttcaggtgattctcctgcctcagcctccctcgcaagtagctgggattacaggcgcctgccaccatgcctagcaaatttttgtatttttagtagagacaggattttaccatgttggccaggctggtctcgaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccgggaagcggaggttgcagtgagccaagatcatgtcactgcgcttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375862 - DNA, 4195 bp, Homo sapiens
  misc_feature (1)..(1): n is a, c, g, or t
  misc_feature (5)..(7): n is a, c, g, or t
ngccnnngcccccgcgccggcggcggcgcggcgcccgcgcttccgtagcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttgagacagagtctcgttctgtcgcccaagctggagcgcaatggtgtgatcttggctcactgcaacatccgcctcccgggttcaggtgattctcctgcctcagcctccctcgcaagtagctgggattacaggcgcctgccaccatgcctagcaaatttttgtatttttagtagagacaggattttaccatgttggccaggctggtctcgaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcatgtcactgcgcttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375863 - DNA, 4249 bp, Homo sapiens
ctctaaagcgcaaggcgagagctgcaaagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttgagacagagtctcgttctgtcgcccaagctggagcgcaatggtgtgatcttggctcactgcaacatccgcctcccgggttcaggtgattctcctgcctcagcctccctcgcaagtagctgggattacaggcgcctgccaccatgcctagcaaatttttgtatttttagtagagacaggattttaccatgttggccaggctggtctcgaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccgggaagcggaggttgcagtgagccaagatcatgtcactgcgcttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375864 - DNA, 4014 bp, Homo sapiens
  misc_feature (1)..(1): n is a, c, g, or t
  misc_feature (5)..(7): n is a, c, g, or t
ngccnnngcccccgcgccggcggcggcgcggcgcccgcgcttccgtagcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttgagacagagtctcgttctgtcgcccaagctggagcgcaatggtgtgatcttggctcactgcaacatccgcctcccgggttcaggtgattctcctgcctcagcctccctcgcaagtagctgggattacaggcgcctgccaccatgcctagcaaatttttgtatttttagtagagacaggattttaccatgttggccaggctggtctcgaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgcccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375865 - DNA, 4318 bp, Homo sapiens
tcagatgtaaaagtcaagagaagactctaaaatcaacattaggtgatcaaaattctgaagtgtctaattaaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttgagacagagtctcgttctgtcgcccaagctggagcgcaatggtgtgatcttggctcactgcaacatccgcctcccgggttcaggtgattctcctgcctcagcctccctcgcaagtagctgggattacaggcgcctgccaccatgcctagcaaatttttgtatttttagtagagacaggattttaccatgttggccaggctggtctcgaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccgggaagcggaggttgcagtgagccaagatcatgtcactgcgcttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375866 - DNA, 4645 bp, Homo sapiens
  misc_feature (1270)..(1270): n is a, c, g, or t
atatatttttaagtggaaaaagcaggcagaacagggaccgtacatattgttgttagtgtcagctcccaaatggatcttattttatctcagatcacagtccttgcaccatgtggctgctggcaccaatgtagagtaaaaaccatctatgtgggcattttttggcacaagaaaaatctcaatctgataccaataaatgtgtgttaaagaatgtcagacttagagtaatcattgcaagttgagcccagataaaactattgcctctctaatgtgttttcttccttctagtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctgatanggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttgagacagagtctcgttctgtcgcccaagctggagcgcaatggtgtgatcttggctcactgcaacatccgcctcccgggttcaggtgattctcctgcctcagcctccctcgcaagtagctgggattacaggcgcctgccaccatgcctagcaaatttttgtatttttagtagagacaggattttaccatgttggccaggctggtctcgaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccgggaagcggaggttgcagtgagccaagatcatgtcactgcgcttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375867 - DNA, 2215 bp, Homo sapiens
gacaaaattagaaaaattaactgggcgtagtggcatgtgctgttgtctcagcctccctcgcaagtagctgggattacaggcgcctgccaccatgcctagcaaatttttgtatttttagtagagacaggattttaccatgttggccaggctggtctcgaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccgggaagcggaggttgcagtgagccaagatcatgtcactgcgcttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375868 - DNA, 2098 bp, Homo sapiens
  misc_feature (11)..(11): n is a, c, g, or t
cgggggaaggnaagtctggcccggagcaattgctcctgccggtaaccccagcactttgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccgggaagcggaggttgcagtgagccaagatcatgtcactgcgcttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375869 - DNA, 1942 bp, Homo sapiens
cctgcgcaacacgccaaagggaccatcacccagcttcttcaggaggcgcaggtccttctccccaatgagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccgggaagcggaggttgcagtgagccaagatcatgtcactgcgcttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375870 - DNA, 1925 bp, Homo sapiens
  misc_feature (1)..(1): n is a, c, g, or t
  misc_feature (5)..(7): n is a, c, g, or t
  misc_feature (1446)..(1446): n is a, c, g, or t
ngccnnngcccccgcgccggcggcggcgcggcgcccgcgcttccgtagcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctgatanggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagagggcgcggccactgatgggggtggtgtcataagtaccttaattgtcgtctttggaggggtg

SEQ ID NO: 375871 - DNA, 1397 bp, Homo sapiens
  misc_feature (1)..(1): n is a, c, g, or t
  misc_feature (5)..(7): n is a, c, g, or t
ngccnnngcccccgcgccggcggcggcgcggcgcccgcgcttccgtagcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctga

SEQ ID NO: 375872 - DNA, 4589 bp, Homo sapiens
  misc_feature (1)..(1): n is a, c, g, or t
  misc_feature (5)..(7): n is a, c, g, or t
ngccnnngcccccgcgccggcggcggcgcggcgcccgcgcttccgtagcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttgagacagagtctcgttctgtcgcccaagctggagcgcaatggtgtgatcttggctcactgcaacatccgcctcccgggttcaggtgattctcctgcctcagcctccctcgcaagtagctgggattacaggcgcctgccaccatgcctagcaaatttttgtatttttagtagagacaggattttaccatgttggccaggctggtctcgaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccgggaagcggaggttgcagtgagccaagatcatgtcactgcgcttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375873 - DNA, 4821 bp, Homo sapiens
  misc_feature (1)..(1): n is a, c, g, or t
  misc_feature (5)..(7): n is a, c, g, or t
  misc_feature (1446)..(1446): n is a, c, g, or t
ngccnnngcccccgcgccggcggcggcgcggcgcccgcgcttccgtagcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctgatanggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttgagacagagtctcgttctgtcgcccaagctggagcgcaatggtgtgatcttggctcactgcaacatccgcctcccgggttcaggtgattctcctgcctcagcctccctcgcaagtagctgggattacaggcgcctgccaccatgcctagcaaatttttgtatttttagtagagacaggattttaccatgttggccaggctggtctcgaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccgggaagcggaggttgcagtgagccaagatcatgtcactgcgcttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375874 - DNA, 4543 bp, Homo sapiens
  misc_feature (1)..(1): n is a, c, g, or t
  misc_feature (5)..(7): n is a, c, g, or t
ngccnnngcccccgcgccggcggcggcgcggcgcccgcgcttccgtagcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttgagacagagtctcgttctgtcgcccaagctggagcgcaatggtgtgatcttggctcactgcaacatccgcctcccgggttcaggtgattctcctgcctcagcctccctcgcaagtagctgggattacaggcgcctgccaccatgcctagcaaatttttgtatttttagtagagacaggattttaccatgttggccaggctggtctcgaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccgggaagcggaggttgcagtgagccaagatcatgtcactgcgcttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375875 - DNA, 5088 bp, Homo sapiens
  misc_feature (1)..(1): n is a, c, g, or t
  misc_feature (5)..(7): n is a, c, g, or t
  misc_feature (1713)..(1713): n is a, c, g, or t
ngccnnngcccccgcgccggcggcggcgcggcgcccgcgcttccgtagcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtgggacaccagaaagctgcctggcctagtctgggacaggcctgggtccatagtctggtttggtcactaaccagcttgacacttggcacggacctcagcccctaagctaatgcctctgctgaggggttgctgcaaggattcgtgacataatggatggagtcctgcttgtcttttgtcttcccacacctaccaatcgcccttagaagtcattgctttgatccagcagccccttggagtgtccttttgatggttatttatttggcctagagctgctgctgctactgcttattgactgagccagtgggagacctctttaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctgatanggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttgagacagagtctcgttctgtcgcccaagctggagcgcaatggtgtgatcttggctcactgcaacatccgcctcccgggttcaggtgattctcctgcctcagcctccctcgcaagtagctgggattacaggcgcctgccaccatgcctagcaaatttttgtatttttagtagagacaggattttaccatgttggccaggctggtctcgaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccgggaagcggaggttgcagtgagccaagatcatgtcactgcgcttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375876 - DNA, 3751 bp, Homo sapiens
cggcgcttgggtttggtgctggaaggcaaatgcactcaggctcagagctagttgctggttgcatttatttccacaatgagccccaccatgagccgcacaacgagccacgcaaagagccacaccatgagccacaccaggagccactctaggagccacaccatgggccaccctaagagccccacgaagagccaggagggttcttggtggcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttgagacagagtctcgttctgtcgcccaagctggagcgcaatggtgtgatcttggctcactgcaacatccgcctcccgggttcaggtgattctcctgcctcagcctccctcgcaagtagctgggattacaggcgcctgccaccatgcctagcaaatttttgtatttttagtagagacaggattttaccatgttggccaggctggtctcgaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccgggaagcggaggttgcagtgagccaagatcatgtcactgcgcttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccacca

SEQ ID NO: 375877 - DNA, 483 bp, Homo sapiens
tctctaactaccaccttcacctctatctaaggagaaactgggatgtttacaaatgcctctgcttttcctctgggttcctgtaatcttcaagtgcctgaaggaacacactttccttcttccttcttcctctctgaacccctgacataaaccccaatttatgatgatcaggagcctggtatctgaataccatcaagggtgagaggaattcacttgaccttctggtgtcatcatatcttttatttatttttgtttattttattttattttgagacagggtctcaccctgttgcccaggctggggtgcaatggtgtgatcttggctcactacaacctccacctcccaggttcaaatgattctcctactcaggaggctgaggcaggagaattgcttgaacctgggaagtggaggttgcagtgaaccaagatcttgccattgcactccagcctgggtgacaagagcagaactccattaaaaaaaaaaaa

SEQ ID NO: 375878 - DNA, 587 bp, Homo sapiens
ccgtagcccactgactcaaatgttaatcttttttggcagcaccctcacagacacacccaggatcaatacttcacatccttcaatccaatcaagttgacactcagtattaaccatcacagggcttcatatattgaatgagatcatgtccaagtcagtgtactttaggggtgttttgagcagggcagaaagaagctaatgctaccaccaaagagagctctgctttgttactggactgccatccactagaatttatgattaaacccattcctacctgctgtttactaggggagaggctgttgtttatttttggcagagcaaacgaacacagtgaggactactgggagactcacttgaagacaggcggattgcatctaagaggtggtgttgcccacactgcaaattgtgcttgtgtctgtctaaacagcaatgaaaactggccaggttcatagtaccctttcaaagtggagttctctaaggaaacattagcttcagttgataactctcaaagaaactaggacagttcccaggctgctctgtatttgtgtagataaacaacaggcattaatagagccatactgaaaaaaaaa

SEQ ID NO: 375879 - DNA, 316 bp, Homo sapiens
ccaattgtcaaagtttctgggcccacaaaatctggacctgctcctaattttttgccacatatctgagtctgggtattttcttcgtggcttttagggggctttggggttctactgccatgcctgtgattcctagtatttggaaggtaactagaggttgcagaccagaaggaacagaaagccacctgacctaagctctagctgtggtagaaaaaggtgtgtaggcctgctatggtgacatagggctagttactttacctgtccctttgctctacacaactgatactatgcatagttccttctacctcaatccaggccc

SEQ ID NO: 375880 - DNA, 806 bp, Homo sapiens
aaggggctcatgcagaagcagttcccggacccgacactctgggtaggagaccactaaacccggcccctcaaagcagaggtgaccttgccctcatcgagagcgcacacaagacgccactgtaaaaggatcacagatggagagacattttgccacacgatgaatcacacaccacatctcatccccgagcttcagctgcaggacaatgctgccagaggcctggtcctcagagctcacgtaagcatctctggtgtgcagtatttttactccgtttttgaccaaagacacctgaacattcctggagaaaacagtgatgtggatcttatcaaatttaatgggcacatctgaagaaggaaacttgctcagcaccgtgagccccacagtgaaagcactttttggcaagactagagtctcaccgattttccctttctctcctcgatctcctttccagcctcttattccccggactcctggctcaccctggggccccgtgggtccagcttctcccttgggaccaggctttccaatagggcccatggggcccggtaaaccagttgggcccaaaggcccaatgttgccccttggcccctcaggaccagtgggacccacgtcacccttattccccttctgcccctgaggcccagtctctcctcggaggcctttctctcccatgggccctgcaagccccttggggccatgttttcctggggatcctcttgagccttgatcacctttgatgccttttgcttcaacttttccatctgctcctaaatagagaaagagcaaataaagagatagtttgtgaaaga

SEQ ID NO: 375881 - DNA, 710 bp, Homo sapiens
aaggggctcatgcagaagcagttcccggacccgacactctgggtaggagaccactaaacccggcccctcaaagcagaggtgaccttgccctcatcgagagcgcacacaagacgccactgtaaaaggatcacagatggagagacattttgccacacgatgaatcacacaccacatctcatccccgagcttcagctgcaggacaatgctgccagaggcctggtcctcagagctcacgtaagcatctctggtgtgcagtatttttactccgtttttgaccaaagacacctgaacattcctggagaaaacagtgatgtggcagaccattgtgaccggggttcccagggattccagggtgcccttgcctgcaggtgtcctgtgagtttatgttccctgtgcagatttcaatggcaagcagaagccaccagatcctcatggttcagatgacagactgaactgaaagagggaaacagaaacccagaggagaaacctttgttgctggggccctggacacagcctccgttctgtgcagtgggaaatggatgagctgtcccctgccccagacccacacctggacagacttggcagaagactcagggcaggggagcaagctggttattaccaggatgacattgtccttggaaggtaacacttgtgattggaaccactcttcaagctgaacgggcaataaaaaaaagccaagtttaaggtca

SEQ ID NO: 375882 - DNA, 301 bp, Homo sapiens
gccagcctcagcctcccaaagtgctgtgattacaggcgtcagccgctgcgcccggcctcctccatagcccttccaacagaagcaccaaatgacaactctagaagaaacatttacaactctttccatttttcatcatacctttaaattataggatgtcatttgatggtttatttcagtggtctgttgttctacttggtggtctatttcattataaaatatatcttttatgacagtaaaccactgggctacagagtcatgataatttctaaattttgctgctgacctctagactcacagtctg

SEQ ID NO: 375883 - DNA, 3232 bp, Homo sapiens
cggctccgggccgctgcgggctccccagctccccacagatcccaggaggggcgggagagcggccatgaagcgaagccgcaaacgcttgtcagctgcctcccggcgccgcccgcgctgctcccattgtcaccgcctcatacgccggaagtggaactgcgcgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggaggtgaagaactctggccagttgttgcttttctgaagaatgacatgatatatgcttgtgttccactagttgaacaaactctgtcccctcgtccgccactaattagtgtcagtggagtttcacaaggctttgaatttctttttgggatacaggattttctttattcaggtcaaaaaaatgactctgagctgaatacaaaattgagccagttgcctgacttgcttctgcaggcttgtccatttggtactttattagatgccaacttacagaattcattagataataccaattttgcatctgtgactcagccacagaaacagccagcttggaaaactgggacgtacaaaggaaaaccacaagtttctatttctatcactgaaaaggtaaaatccatgcaatatgataaacagggtatagcagatacatggcaagttgttggaacagtgacttgcaagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtccctgtcccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacaccggaaactaatttcttctgattattacatctggaattctaaagcccctgctccagtaacatatggatcattattattgtaatagtctcatgtttaaatgggattatataatgataacagtttaaagaaaatcataatcttatatttttaatgtggatgcatataacctgtgagtgaaaaatcactgaatgatttaattgtaaaagtagtcttatgtggtgtttgtagtctgatagagcttgaaaggacattttaaaagctaatgtctccaattttgttaaccttcgattttatgccagtataattcagaacatagaaaagtaatgattcacttgggctcattttagactggtcctgggtcaccctgccacacttgtttcctagtgtttctgtggcagacattgctaatcaattacagcccttttctgtactgagccttggataaagggtcaggctcctttttagttcagagattcaggcagccactcccagtgggttgtagataatgtgcaagataaaaactattttctcttccaaatctaagtactaagctcctagtataaggtgttgttacagaataccagagaccatgttagagacaactacatctcttcaaaaaacagccaacagagacaaaggaaaagtgtttaaatagtaagctgttcttcttaatcagaactatcctattgactaataaataatctgcataattctacttaaggtgtgtaatctctgttctagagttagtttttaagtaagcttgttaatctgccactttgacattttgcttaggatgtcagtagccatattaagatgtgtagaataccttcagaagatgatcatagtgttttgtaatcatttaatgtctgcagccaaatttttaaaggtaatttagacctaatactgctcttgctgtgtcttattaagttaaaattaatgaatgaattctggtaaaaattcaaaaggcactctgtgagtagagagtatcatttaagcttattttagtcacatgtagtatatatctccttaaagctgtcactctcactttcttaccattctcttgatttcttcagaaaccatctagtcatcatctttatactctacctgcttctgcaattatatatcatattatgttttcagagcagttcattgtcaagttggactttaagtgaccattcaagaaaagatgaaatctcacgaacctcaaaacttcattcatgtctttttacaaatgagaaaaaaaaatgcattaaagattaatactcaatttgattata

SEQ ID NO: 375884 - DNA, 653 bp, Homo sapiens
cggctccgggccgctgcgggctccccagctccccacagatcccaggaggggcgggagagcggccatgaagcgaagccgcaaacgcttgtcagctgcctcccggcgccgcccgcgctgctcccattgtcaccgcctcatacgccggaagtggaactgcgcgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctacatggcttaatctaacccgctgggacccgtttcaaagccgccaaatggggggccggccaaagaccggggagcccaaggtggttgggcgtcaatagagccagcgaaccg

SEQ ID NO: 375885 - DNA, 3273 bp, Homo sapiens
cggctccgggccgctgcgggctccccagctccccacagatcccaggaggggcgggagagcggccatgaagcgaagccgcaaacgcttgtcagctgcctcccggcgccgcccgcgctgctcccattgtcaccgcctcatacgccggaagtggaactgcgcgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagggattggcaagaagactcagggtacctgtcattcactataaacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggaggtgaagaactctggccagttgttgcttttctgaagaatgacatgatatatgcttgtgttccactagttgaacaaactctgtcccctcgtccgccactaattagtgtcagtggagtttcacaaggctttgaatttctttttgggatacaggattttctttattcaggtcaaaaaaatgactctgagctgaatacaaaattgagccagttgcctgacttgcttctgcaggcttgtccatttggtactttattagatgccaacttacagaattcattagataataccaattttgcatctgtgactcagccacagaaacagccagcttggaaaactgggacgtacaaaggaaaaccacaagtttctatttctatcactgaaaaggtaaaatccatgcaatatgataaacagggtatagcagatacatggcaagttgttggaacagtgacttgcaagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtccctgtcccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacaccggaaactaatttcttctgattattacatctggaattctaaagcccctgctccagtaacatatggatcattattattgtaatagtctcatgtttaaatgggattatataatgataacagtttaaagaaaatcataatcttatatttttaatgtggatgcatataacctgtgagtgaaaaatcactgaatgatttaattgtaaaagtagtcttatgtggtgtttgtagtctgatagagcttgaaaggacattttaaaagctaatgtctccaattttgttaaccttcgattttatgccagtataattcagaacatagaaaagtaatgattcacttgggctcattttagactggtcctgggtcaccctgccacacttgtttcctagtgtttctgtggcagacattgctaatcaattacagcccttttctgtactgagccttggataaagggtcaggctcctttttagttcagagattcaggcagccactcccagtgggttgtagataatgtgcaagataaaaactattttctcttccaaatctaagtactaagctcctagtataaggtgttgttacagaataccagagaccatgttagagacaactacatctcttcaaaaaacagccaacagagacaaaggaaaagtgtttaaatagtaagctgttcttcttaatcagaactatcctattgactaataaataatctgcataattctacttaaggtgtgtaatctctgttctagagttagtttttaagtaagcttgttaatctgccactttgacattttgcttaggatgtcagtagccatattaagatgtgtagaataccttcagaagatgatcatagtgttttgtaatcatttaatgtctgcagccaaatttttaaaggtaatttagacctaatactgctcttgctgtgtcttattaagttaaaattaatgaatgaattctggtaaaaattcaaaaggcactctgtgagtagagagtatcatttaagcttattttagtcacatgtagtatatatctccttaaagctgtcactctcactttcttaccattctcttgatttcttcagaaaccatctagtcatcatctttatactctacctgcttctgcaattatatatcatattatgttttcagagcagttcattgtcaagttggactttaagtgaccattcaagaaaagatgaaatctcacgaacctcaaaacttcattcatgtctttttacaaatgagaaaaaaaaatgcattaaagattaatactcaatttgattata

SEQ ID NO: 375886 - DNA, 2586 bp, Homo sapiens
cggctccgggccgctgcgggctccccagctccccacagatcccaggaggggcgggagagcggccatgaagcgaagccgcaaacgcttgtcagctgcctcccggcgccgcccgcgctgctcccattgtcaccgcctcatacgccggaagtggaactgcgcgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtccctgtcccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacaccggaaactaatttcttctgattattacatctggaattctaaagcccctgctccagtaacatatggatcattattattgtaatagtctcatgtttaaatgggattatataatgataacagtttaaagaaaatcataatcttatatttttaatgtggatgcatataacctgtgagtgaaaaatcactgaatgatttaattgtaaaagtagtcttatgtggtgtttgtagtctgatagagcttgaaaggacattttaaaagctaatgtctccaattttgttaaccttcgattttatgccagtataattcagaacatagaaaagtaatgattcacttgggctcattttagactggtcctgggtcaccctgccacacttgtttcctagtgtttctgtggcagacattgctaatcaattacagcccttttctgtactgagccttggataaagggtcaggctcctttttagttcagagattcaggcagccactcccagtgggttgtagataatgtgcaagataaaaactattttctcttccaaatctaagtactaagctcctagtataaggtgttgttacagaataccagagaccatgttagagacaactacatctcttcaaaaaacagccaacagagacaaaggaaaagtgtttaaatagtaagctgttcttcttaatcagaactatcctattgactaataaataatctgcataattctacttaaggtgtgtaatctctgttctagagttagtttttaagtaagcttgttaatctgccactttgacattttgcttaggatgtcagtagccatattaagatgtgtagaataccttcagaagatgatcatagtgttttgtaatcatttaatgtctgcagccaaatttttaaaggtaatttagacctaatactgctcttgctgtgtcttattaagttaaaattaatgaatgaattctggtaaaaattcaaaaggcactctgtgagtagagagtatcatttaagcttattttagtcacatgtagtatatatctccttaaagctgtcactctcactttcttaccattctcttgatttcttcagaaaccatctagtcatcatctttatactctacctgcttctgcaattatatatcatattatgttttcagagcagttcattgtcaagttggactttaagtgaccattcaagaaaagatgaaatctcacgaacctcaaaacttcattcatgtctttttacaaatgagaaaaaaaaatgcattaaagattaatactcaatttgattata

SEQ ID NO: 375887 - DNA, 1940 bp, Homo sapiens
cggctccgggccgctgcgggctccccagctccccacagatcccaggaggggcgggagagcggccatgaagcgaagccgcaaacgcttgtcagctgcctcccggcgccgcccgcgctgctcccattgtcaccgcctcatacgccggaagtggaactgcgcgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggaggtgaagaactctggccagttgttgcttttctgaagaatgacatgatatatgcttgtgttccactagttgaacaaactctgtcccctcgtccgccactaattagtgtcagtggagtttcacaaggctttgaatttctttttgggatacaggattttctttattcaggtcaaaaaaatgactctgagctgaatacaaaattgagccagttgcctgacttgcttctgcaggcttgtccatttggtactttattagatgccaacttacagaattcattagataataccaattttgcatctgtgactcagccacagaaacagccagcttggaaaactgggacgtacaaaggaaaaccacaagtttctatttctatcactgaaaaggtaaaatccatgcaatatgataaacagggtatagcagatacatggcaagttgttggaacagtgacttgcaagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtaacaaccctagaatagttgagagtttgctgatctttatattcataaatactattgataagtagataattcatactcttggtatgagaacttagaaaaagttctatttatcagacaataattgatgattgaagatgaagatttagaccaggcacggtggctcatgcctgtaatcccagcagtttgggaggctgaggcaggtggatcacttgaggtcaggagttcgaggccagcctggccaacacgatgaaaccttgtctctactaaaaatacaaaaagttagccaggcgtggtgtcatgcacctgtaatcccatctacttgggtggccgaggcaggagaatcgcttgaacccaggtggcggaggttgcggtgagccaagatcgcaccagcgcactccagcctgggcgacagagtgagactccatctc

SEQ ID NO: 375888 - DNA, 674 bp, Homo sapiens
tctagagttagtttttaagtaaaattatgcagattatttattagtcaataggatagttctgattaagaagaacagctatcctattgactaataaataatctgcataattctacttaaggtgtgtaatctctgttctagagttagtttttaagtaagcttgttaatctgccactttgacattttgcttaggatgtcagtagccatattaagatgtgtagaataccttcagaagatgatcatagtgttttgtaatcatttaatgtctgcagccaaatttttaaaggtaatttagacctaatactgctcttgctgtgtcttattaagttaaaattaatgaatgaattctggtaaaaattcaaaaggcactctgtgagtagagagtatcatttaagcttattttagtcacatgtagtatatatctccttaaagctgtcactctcactttcttaccattctcttgatttcttcagaaaccatctagtcatcatctttatactctacctgcttctgcaattatatatcatattatgttttcagagcagttcattgtcaagttggactttaagtgaccattcaagaaaagatgaaatctcacgaacctcaaaacttcattcatgtctttttacaaatgagaaaaaaaaatgcattaaagattaatactcaatttgattata

SEQ ID NO: 375889 - DNA, 2670 bp, Homo sapiens
cggctccgggccgctgcgggctccccagctccccacagatcccaggaggggcgggagagcggccatgaagcgaagccgcaaacgcttgtcagctgcctcccggcgccgcccgcgctgctcccattgtcaccgcctcatacgccggaagtggaactgcgcgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggaggtgaagaactctggccagttgttgcttttctgaagaatgacatgatatatgcttgtgttccactagttgaacaaactctgtcccctcgtccgccactaattagtgtcagtggagtttcacaaggctttgaatttctttttgggatacaggattttctttattcaggtcaaaaaaatgactctgagctgaatacaaaattgagccagttgcctgacttgcttctgcaggcttgtccatttggtactttattagatgccaacttacagaattcattagataataccaattttgcatctgtgactcagccacagaaacagccagcttggaaaactgggacgtacaaaggaaaaccacaagtttctatttctatcactgaaaaggtaaaatccatgcaatatgataaacagggtatagcagatacatggcaagttgttggaacagtgacttgcaagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtccctgtcccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacaccggaaactaatttcttctgattattacatctggaattctaaagcccctgctccagtaacatatggatcattattattgtaatagtctcatgtttaaatgggattatataatgataacagtttaaagaaaatcataatcttatatttttaatgtggatgcatataacctgtgagtgaaaaatcactgaatgatttaattgtaaaagtagtcttatgtggtgtttgtagtctgatagagcttgaaaggacattttaaaagctaatgtctccaattttgttaaccttcgattttatgccagtataattcagaacatagaaaagtaatgattcacttgggctcattttagactggtcctgggtcaccctgccacacttgtttcctagtgtttctgtggcagacattgctaatcaattacagcccttttctgtactgagccttggataaagggtcaggctcctttttagttcagagattcaggcagccactcccagtgggttgtagataatgtgcaagataaaaactattttctcttccaaatctaagtactaagctcctagtataaggtgttgttacagaataccagagaccatgttagagacaactacatctcttcaaaaaacagccaacagagacaaaggaaaagtgtttaaatagtaagctgttcttcttaatcagaactatcctattgactaataaataatctgcataattcta

SEQ ID NO: 375890 - DNA, 2780 bp, Homo sapiens
cggctccgggccgctgcgggctccccagctccccacagatcccaggaggggcgggagagcggccatgaagcgaagccgcaaacgcttgtcagctgcctcccggcgccgcccgcgctgctcccattgtcaccgcctcatacgccggaagtggaactgcgcgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtccctgtcccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacaccggaaactaatttcttctgattattacatctggaattctaaagcccctgctccagtaacatatggatcattattattgtaatagtctcatgtttaaatgggattatataatgataacagtttaaagaaaatcataatcttatatttttaatgtggatgcatataacctgtgagtgaaaaatcactgaatgatttaattgtaaaagtagtcttatgtggtgtttgtagtctgatagagcttgaaaggacattttaaaagctaatgtctccaattttgttaaccttcgattttatgccagtataattcagaacatagaaaagtaatgattcacttgggctcattttagactggtcctgggtcaccctgccacacttgtttcctagtgtttctgtggcagacattgctaatcaattacagcccttttctgtactgagccttggataaagggtcaggctcctttttagttcagagattcaggcagccactcccagtgggttgtagataatgtgcaagataaaaactattttctcttccaaatctaagtactaagctcctagtataaggtgttgttacagaataccagagaccatgttagagacaactacatctcttcaaaaaacagccaacagagacaaaggaaaagtgtttaaatagtaagctgttcttcttaatcagaactatcctattgactaataaataatctgcataattctacttaaggtgtgtaatctctgttctagagttagtttttaagtaagcttgttaatctgccactttgacattttgcttaggatgtcagtagccatattaagatgtgtagaataccttcagaagatgatcatagtgttttgtaatcatttaatgtctgcagccaaatttttaaaggtaatttagacctaatactgctcttgctgtgtcttattaagttaaaattaatgaatgaattctggtaaaaattcaaaaggcactctgtgagtagagagtatcatttaagcttattttagtcacatgtagtatatatctccttaaagctgtcactctcactttcttaccattctcttgatttcttcagaaaccatctagtcatcatctttatactctacctgcttctgcaattatatatcatattatgttttcagagcagttcattgtcaagttggactttaagtgaccattcaagaaaagatgaaatctcacgaacctcaaaacttcattcatgtctttttacaaatgagaaaaaaaaatgcattaaagattaatactcaatttgattata

SEQ ID NO: 375891 - DNA, 2718 bp, Homo sapiens
cggctccgggccgctgcgggctccccagctccccacagatcccaggaggggcgggagagcggccatgaagcgaagccgcaaacgcttgtcagctgcctcccggcgccgcccgcgctgctcccattgtcaccgcctcatacgccggaagtggaactgcgcgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggaggtgaagaactctggccagttgttgcttttctgaagaatgacatgatatatgcttgtgttccactagttgaacaaactctgtcccctcgtccgccactaattagtgtcagtggagtttcacaaggctttgaatttctttttgggatacaggattttctttattcaggtcaaaaaaatgactctgagctgaatacaaaattgagccagttgcctgacttgcttctgcaggcttgtccatttggtactttattagatgccaacttacagaattcattagataataccaattttgcatctgtgactcagccacagaaacagccagcttggaaaactgggacgtacaaaggaaaaccacaagtttctatttctatcactgaaaaggtaaaatccatgcaatatgataaacagggtatagcagatacatggcaagttgttggaacagtgacttgcaaggtgagatttttctctggtacttgctttatcgttttatttaacatatggagaaaagttaaatttgctagttgtattttaaataacattttttattttcatcttaagcagcagtttttaaatgggagagtcatgtaaaattttatgttatctttttgcattccttaccaattatattagttatctgtggctgtgtaaagaattgtctcattgtccccaaaatagacatttattattttcatagtttctgtagggattagcttagctgggaactttcagggtagaatcactcatgaagttgcagtcaagttttcagttgaggctatagtcatctgaaggtctgactgaggctggaagatctgcttgcaagatgactcactcacatggctaacaagttggtcctagttattggaggaaggccttagttcctttccacatggacttctcaactggctgcttaagtgtcctcacacttggtgactggcttccctcagaccagatgatgagagaggggtgggggggggagagagagaggagagagagagagagagaagagagaagagagagaagagagaagagaaaagagagaggagagagacaggcaggcaggcaggcagaagcgattatttttattacctagctgggaggttacacttccactactttctgttcattagaagcaagtcactaagtggtccatattcaaggggcgtggaataaggctccacctatgaaaagagtaatgtcaaataacttcagaacatattttaaagtcaccactgctgttttccattttctttagagggatgaaattgacatctctgacatatctaaaatcatgttgaagggctcttatttaaacaagtcgttaggttaatattgggttctctgtagaaatagaaaacaggaaaacacaacgtaaataacaatacagttagcagtgattaatgccatgttgaataatgatcaaaaataaaatcctccaggtaaacttcctacaagtttatattaatagtattctcatttctttatttttctatcttcctttattccctgcagttacgtatactttttatatgtcaaatttaatgttgtgtggctatgtataaatattatagaataaaactagagttcaagagcagagaattagaacagtcctgacagaaaaatcgggtctgtctttttttttaatcctgtttaacgttaaagttacctaaaagttttggtgtctattttaaactcatatctatcatggtcaaaaatatactccagttactcactttattagaaataactattgtaaatggctccaaaattgaggtgttcatggattatgtcatccttaagttttaaagtagttaaatcttttttctcctaagttcaatgaaatgaaaatagaaaaatatggcctggcgcagtggctcactcctgtaatcc

SEQ ID NO: 375892 - DNA, 2328 bp, Homo sapiens
cggctccgggccgctgcgggctccccagctccccacagatcccaggaggggcgggagagcggccatgaagcgaagccgcaaacgcttgtcagctgcctcccggcgccgcccgcgctgctcccattgtcaccgcctcatacgccggaagtggaactgcgcgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggaggtgaagaactctggccagttgttgcttttctgaagaatgacatgatatatgcttgtgttccactagttgaacaaactctgtcccctcgtccgccactaattagtgtcagtggagtttcacaaggctttgaatttctttttgggatacaggattttctttattcaggtcaaaaaaatgactctgagctgaatacaaaattgagccagttgcctgacttgcttctgcaggcttgtccatttggtactttattagatgccaacttacagaattcattagataataccaattttgcatctgtgactcagccacagaaacagccagcttggaaaactgggacgtacaaaggaaaaccacaagtttctatttctatcactgaaaaggtaaaatccatgcaatatgataaacagggtatagcagatacatggcaagttgttggaacagtgacttgcaagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtccctgtcccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacaccggaaactaatttcttctgattattacatctggaattctaaagcccctgctccagtaacatatggatcattattattgtaatagtctcatgtttaaatgggattatataatgataacagtttaaagaaaatcataatcttatatttttaatgtggatgcatataacctaaaccatctagtcatcatctttatactctacctgcttctgcaattatatatcatattatgttttcagagcagttcattgtcaagttggactttaagtgaccattcaagaaaagatgaaatctcacgaacctcaaaacttcattcatgtctttttacaaatgagaaaaaaaaatgcattaaagattaatactcaatttgattata

SEQ ID NO: 375893 - DNA, 2489 bp, Homo sapiens
cggctccgggccgctgcgggctccccagctccccacagatcccaggaggggcgggagagcggccatgaagcgaagccgcaaacgcttgtcagctgcctcccggcgccgcccgcgctgctcccattgtcaccgcctcatacgccggaagtggaactgcgcgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggaggtgaagaactctggccagttgttgcttttctgaagaatgacatgatatatgcttgtgttccactagttgaacaaactctgtcccctcgtccgccactaattagtgtcagtggagtttcacaaggctttgaatttctttttgggatacaggattttctttattcaggtcaaaaaaatgactctgagctgaatacaaaattgagccagttgcctgacttgcttctgcaggcttgtccatttggtactttattagatgccaacttacagaattcattagataataccaattttgcatctgtgactcagccacagaaacagccagcttggaaaactgggacgtacaaaggaaaaccacaagtttctatttctatcactgaaaaggtaaaatccatgcaatatgataaacagggtatagcagatacatggcaagttgttggaacagtgacttgcaaggtgagatttttctctggtacttgctttatcgttttatttaacatatggagaaaagttaaatttgctagttgtattttaaataacattttttattttcatcttaagcagcagtttttaaatgggagagtcatgtaaaattttatgttatctttttgcattccttaccaattatattagttatctgtggctgtgtaaagaattgtctcattgtccccaaaatagacatttattattttcatagtttctgtagggattagcttagctgggaactttcagggtagaatcactcatgaagttgcagtcaagttttcagttgaggctatagtcatctgaaggtctgactgaggctggaagatctgcttgcaagatgactcactcacatggctaacaagttggtcctagttattggaggaaggccttagttcctttccacatggacttctcaactggctgcttaagttggtccatattcaaggggcgtggaataaggctccacctatgaaaagagtaatgtcaaataacttcagaacatattttaaagtcaccactgctgttttccattttctttagagggatgaaattgacatctctgacatatctaaaatcatgttgaagggctcttatttaaacaagtcgttaggttaatattgggttctctgtagaaatagaaaacaggaaaacacaacgtaaataacaatacagttagcagtgattaatgccatgttgaataatgatcaaaaataaaatcctccaggtaaacttcctacaagtttatattaatagtattctcatttctttatttttctatcttcctttattccctgcagttacgtatactttttatatgtcaaatttaatgttgtgtggctatgtataaatattatagaataaaactagagttcaagagcagagaattagaacagtcctgacagaaaaatcgggtctgtctttttttttaatcctgtttaacgttaaagttacctaaaagttttggtgtctattttaaactcatatctatcatggtcaaaaatatactccagttactcactttattagaaataactattgtaaatggctccaaaattgaggtgttcatggattatgtcatccttaagttttaaagtagttaaatcttttttctcctaagttcaatgaaatgaaaatagaaaaatatggcctggcgcagtggctcactcctgtaatcc

SEQ ID NO: 375894 - DNA, 748 bp, Homo sapiens
attttattaaattgtaattaatttaaattggaataacaacatgtggccagtggctaccatattggaaatgagagctctagagggtctcataaattcacatggctttatttactattgtgacactgatgactcccaaattaactctacagtccatgtcctactctaaatctaaacttcactgtgtatcctatgtatttatttgcctacttttcatccacccctaccttaatatctcggttttctcagctgcaccttgtactaaacaggttaaaaactgaacttggccgggcgctgtggctgatgcctataatcccagcactttgggaggccgaggcgggcagatcacgaggtcaggagatggagaccatcctggtcaacatggtgaaaccccgtctctactaaaaatacaaaaattagctgggcttggtggcacatgcctgtaaacccagctattcgggacgctgaggcgggagaatcgcttgaacctggaaggcggaggttgcagtgagccgagatctcgccactgcacttcagcctggcgacatagcgagactcctttgacctccacctcttcggagcctactactcttgacttgatctccactttccacaaatcctagctgaccgtctaccctaattcccaggtgaatgagtaaactgatgccgctgaaagaattcagctggtgaatggatgagcagtggatctttacaaaatgaaatacaactcagcaaaaaaaaaaaaaaaaaa

SEQ ID NO: 375895 - DNA, 266 bp, Homo sapiens
cggccctgtgtgaacctcaaggattgtttgctgtacttttttttagtggttctttccccagaccctggtagtgtcctcaggtgcttgtgctgcaattaatgagtactcagctgagtggggaactctggatatctgcagagttctttctctgggaggctttcacctgaactctctactaccttgcaaacaaactagccactttggcctccttgtacttatagctctatctcttcacttcaggaatttgctgagctccatctagattc

SEQ ID NO: 375896 - DNA, 1370 bp, Homo sapiens
ttgaacccatcagttgggttctggtcagtagtagtaaaaaaaaaaaaaaattaaaatgtaatatacatataggaaaatgcacattgtcataagtgtagtcagtgattattcataaacttcatataaataacaccaaacacccagtacttccaaagctctttgtgtttttttctagttgtgaagacccgtccccttccctcctccctctttaccccccacgtatcctgtaaccagtatcccaacctagattatgtttagggcattaggattttaacatagggaaggattctggttagaatggacctgctgttgtttagcagtggggaccctggggccaaagcgcagggtagagttgcggtgcagcctgcctgctaaatttatgagaggacaaccctgaggaaagttccaagagcttccagctctgaatttctcctttaatcctcacgtatttttagggaaccagccatatttgagaacttactacccctttaaggttataaatcattccccttttcccccatgtatattggatgcattgttattattaaacacatttaaggccaggcgcagtggctcacgcttgtaatcccagcactttgggaggccgaggcgggcagatcacgaggtcaggagatcgagaccatcctggctaacatggtgaaaccccgtctctactaaaaatacaaaaaaattagccgggcttggtggcaggcacctgtagtcccagctactcgggaggctgaggcaggagaatggcttgaacccgggaggcggagctttcagtgagccgaggatcgtgccactgcactccagagtgagactctgtctcaaaaaaaaaaaaaaaaaaaaaattaaaagttttgatacaacatttaccatgttaacattttttactttacacgttagttcacattttttgtagagacagagtctcactatgttgcccagcctagtcttgaactcttaacctcaagccatcctccctcctcagcctcccaaagtgctgggattacaggtgtaagccaccacatctgactgagaatgtttttgtcttacaaagctgaaattctttctcattaaacttactgggtgtgttttaatattcttttttactttttgttacagaaaatgtcgcacatattccaaagtagaaagaatggtatagtgaatacccatggacctgatagacctgggtattcaataattatcaattacatttcatttatatttctgcatgactacctcacattatattacttagaagcaaataccaggcatcatagtattttatatgaaaatatttcagtatatatctctaaaggaggcaaactttaaaaatccctgctattgttattatacctaaaaaaaaa

SEQ ID NO: 375897 - DNA, 598 bp, Homo sapiens
aggagtccccctgaatggatgattgctgtttcaggaccgggattagaggctgtgatagactgtgcagtggcaaaagtattaacaagagtggcgatgaggatggcagttggggcgtccaggctgctgactgagtgcccgcctgtcggtacagccagccaggccttcgacaagcacctgcctggaaaccgggctcgctgtcctgaaagcctggactggatgtcacgatggggagaacgggatcgcgatacccaagctggggcacaggcgagccagggacactggtttactggggtgataacacccagccctgctatcgcgatccgtttgcactgtggtcagctgtctccacgccgtggttggagagggcttgtctccgggcgccactgctggtgtgtatggtctgtcttagtgtcccctgcaagttgcattggagattgctgggtggcagggagggaaatgggaagagaatctgtggggtcatggtggtgaaggctgctggtttttaatcccttctcaaccagtccaggacacttgtctcccagagataactggggggggactgcctaaccccccctcccccacccctttccctacccca

SEQ ID NO: 375898 - DNA, 1907 bp, Homo sapiens
ctcacgttggggctacttgttttagggcgcaaaggaacggcctcgaaagggggtccttccccagccgagaaccaggaatcttccctcggcccgcgcgcgcgaccggccggtgcgccgcggcccgcggacaatcctccaaacacagactgtttgacttagaatcttcccttttttactccattcaagagcagcattcataaatttccagaatggagatctcctctcatcagtctcacctcctgcagcaactgaacgagcagcgcaggcaagatgtattttgtgactgcagtattctagttgaagggaaggtcttcaaagcacatcgaaatgtattattcgctagtagcggctactttaaaatgcttctttctcagaattcaaaggagacgagtcagccaaccacagctacatttcaggctttctcccctgacacttttacagttatcttggacttcgtatattctggcaaactgtctcttactggtcagaatgtcatagaagtgatgtcggctgctagcttccttcagatgactgatgtcataagtgtatgtaagacttttattaaatcttccttagacattagtgagaaagaaaaagatcgctatttcagtctctcagataaagatgccaattctaatggtgtagaacgttcctctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacagattgatgctgaaatggactctactcctgttggctatcagtacggtcaaggatctgatgtcacatccaaaagctttccagatgatctgcctcggatgcgattcaagtgcccgtactgcacacatgtggtgaagcggaaggcagacctaaagcgccaccttcgttgtcatacaggagaaaggccctatccatgtcaagcttgtggaaaaagatttagcaggctagaccatctaagtagccattttcgaacaattcaccaggcatgtaaactcatctgcagaaaatgtaaacgtcatgtgacagatctaacagggcaagtggtacaggagggaaccaggcgctacagactgtgtaatgagtgtcttgcagaatttggcatagacagcctccccattgacttggaagctgaacaacatcttatgtccccatcagatggagataaggattccagatggcacttgagtgaagatgagaatagatcctatgtggagattgtagaagatgggtctgctgatctggtcatccaacaggttgatgatagtgaagaagaagaagaaaaagaaattaagcccaacattaggtagctgtaatgtgaaccaacagagctggcatgtctgcaatttacattgacttcctgtatctctctctttctatggtcggagtctagttaacaaatttatcacactgactttaaagaaatgatctgatataacttgcatgctttctgaacaggccattgtatccattctgaactttgttgccctaaaatgtgttgctgcactggaaagaaagaactagcttgagttggcttgatggatgaacaattatcctcttactttcattacaatcctcttactttattccagagatacctttttcttttaatattggaggatctacttagcaaacttttttcaaagaaaatactttaaataaattcaccacaaccaaacttt

SEQ ID NO: 375899 - DNA, 2170 bp, Homo sapiens
ctcacgttggggctacttgttttagggcgcaaaggaacggcctcgaaagggggtccttccccagccgagaaccaggaatcttccctcggcccgcgcgcgcgaccggccggtgcgccgcggcccgcggacaatcctccaaacacagactgtttgacttagaatcttcccttttttactccattcaagagcagcattcataaatttccagaatggagatctcctctcatcagtctcacctcctgcagcaactgaacgagcagcgcaggcaagatgtattttgtgactgcagtattctagttgaagggaaggtcttcaaagcacatcgaaatgtattattcgctagtagcggctactttaaaatgcttctttctcagaattcaaaggagacgagtcagccaaccacagctacatttcaggctttctcccctgacacttttacagttatcttggacttcgtatattctggcaaactgtctcttactggtcagaatgtcatagaagtgatgtcggctgctagcttccttcagatgactgatgtcataagtgtatgtaagacttttattaaatcttccttagacattagtgagaaagaaaaagatcgctatttcagtctctcagataaagatgccaattctaatggtgtagaacgttcctctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacagattgatgctgaaatggactctactcctgttggctatcagtacggtcaaggatctgatgtcacatccaaaagctttccagatgatctgcctcggatgcgattcaagtgcccgtactgcacacatgtggtgaagcggaaggcagacctaaagcgccaccttcgttgtcatacaggagaaaggccctatccatgtcaagcttgtggaaaaagatttagcaggctagaccatctaagtagccattttcgaacaattcaccaggcatgtaaactcatctgcagaaaatgtaaacgtcatgtgacagatctaacagggcaagtggtacaggagggaaccaggcgctacagactgtgtaatgagtgtcttgcagaatttggcatagacagcctccccattgacttggaagctgaacaacatcttatgtccccatcagatggagataaggattccagatggcacttgagtgaagatgagaatagatcctatgtggagattgtagaagatgggtctgctgatctggtcatccaacaggttgatgatagtgaagaagaagaagaaaaagaaattaagcccaacattaggtagctgtaatgtgaaccaacagagctggcatgtctgcaatttacattgacttcctgtatctctctctttctatggtcggagtctagttaacaaatttatcacactgactttaaagaaatgatctgatataacttgcatgctttctgaacaggccattgtatccattctgaactttgttgccctaaaatgtgttgctgcactggaaagaaagaactagcttgagttggcttgatggatgaacaattatcctcttactttcattacaatcctcttactttattccagagatacctttttcttttaatattggaggatctacttagcaaacttttttcaaagaaaatactttaaataaattcaccacaaccaaactttatgtaagacaatttcaaggtgtttcaaaaacacataactaccaatgtttaatttcacagggaaccagttaagagcacatttaaggatctggcaacccaccttactaaacaaattagtctttctattaatttgagatctgaaacaacctgtcattactctgatatcctgaacgtttaaggattatggaagaagactaaagtgtttgaaatcattcatatttgaaatttttatcattagcttaaaaattactctcagtattgtta

SEQ ID NO: 375900 - DNA, 1989 bp, Homo sapiens
ctcacgttggggctacttgttttagggcgcaaaggaacggcctcgaaagggggtccttccccagccgagaaccaggaatcttccctcggcccgcgcgcgcgaccggccggtgcgccgcggcccgcggacaatcctccaaacacagactgtttgacttagaatcttcccttttttactccattcaagagcagcattcataaatttccagaatggagatctcctctcatcagtctcacctcctgcagcaactgaacgagcagcgcaggcaagatgtattttgtgactgcagtattctagttgaagggaaggtcttcaaagcacatcgaaatgtattattcgctagtagcggctactttaaaatgcttctttctcagaattcaaaggagacgagtcagccaaccacagctacatttcaggctttctcccctgacacttttacagttatcttggacttcgtatattctggcaaactgtctcttactggtcagaatgtcatagaagtgatgtcggctgctagcttccttcagatgactgatgtcataagtgtatgtaagacttttattaaatcttccttagacattagtgagaaagaaaaagatcgctatttcagtctctcagataaagatgccaattctaatggtgtagaacgttcctctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacagattgatgctgaaatggactctactcctgttggctatcagtacggtcaaggatctgatgtcacatccaaaagctttccagatgatctgcctcggatgcgattcaagtgcccgtactgcacacatgtggtgaagcggaaggcagacctaaagcgccaccttcgttgtcatacaggagaaaggccctatccatgtcaagcttgtggaaaaagatttagcaggctagaccatctaagtagccattttcgaacaatggagataaggattccagatggcacttgagtgaagatgagaatagatcctatgtggagattgtagaagatgggtctgctgatctggtcatccaacaggttgatgatagtgaagaagaagaagaaaaagaaattaagcccaacattaggtagctgtaatgtgaaccaacagagctggcatgtctgcaatttacattgacttcctgtatctctctctttctatggtcggagtctagttaacaaatttatcacactgactttaaagaaatgatctgatataacttgcatgctttctgaacaggccattgtatccattctgaactttgttgccctaaaatgtgttgctgcactggaaagaaagaactagcttgagttggcttgatggatgaacaattatcctcttactttcattacaatcctcttactttattccagagatacctttttcttttaatattggaggatctacttagcaaacttttttcaaagaaaatactttaaataaattcaccacaaccaaactttatgtaagacaatttcaaggtgtttcaaaaacacataactaccaatgtttaatttcacagggaaccagttaagagcacatttaaggatctggcaacccaccttactaaacaaattagtctttctattaatttgagatctgaaacaacctgtcattactctgatatcctgaacgtttaaggattatggaagaagactaaagtgtttgaaatcattcatatttgaaatttttatcattagcttaaaaattactctcagtattgtta

SEQ ID NO: 375901 - DNA, 1698 bp, Homo sapiens
ggctgggcctgcggaagggggcgggttcggaggagtgaactgtgcggttagtgcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactcta

SEQ ID NO: 375902 - DNA, 1062 bp, Homo sapiens
ggctgggcctgcggaagggggcgggttcggaggagtgaactgtgcggttagtgcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattgtggaggaatgaacgtaattaactttgaacatcttgatacagaaagacctgaatctgtgtgcaaaagtgactaagttccctttatccccctggaattcccatgagttgaggatcatctgaatttgagttgcatccatgaacagttttatcccttggtttcttatttgcgtggaaggcattttcataacgaagtactggtttagtaaaagcagtaaataggagtctccatgcaagagaaattggagtttcctaacatgcatgtgattta

SEQ ID NO: 375903 - DNA, 537 bp, Homo sapiens
tttctccctttattcactgttaaatctaattagtttaaaggcttcaaatattaaggaatataaatgataaaaacgttatgttatttttggaagtttttctcatatctctgttgccagggctattcaatcacttaatatttaattgaatatgaaattattctttttgtgtacctgggtgcactaaatatttgaaactatgtattttaaattacaataaaaaagtaatttctttgtttaaagatttctttaggaaaagagaccacttgcaacaagggtctgcgaatttcatatatgacgatgtgagtatcctgcttttgatatttatactgcattctagatagttctcagttagtaaaaaaatttaagtgatcccaagtaccagtactggaaataatatatttggtatgccacatacttttccatatttttcagtgtaacacaaatataagattaatattggtataggtgccaaacaatttgacttcatgttaaattgtaaatatgcttttcaatttttatgacaggttttttgaatta

SEQ ID NO: 375904 - DNA, 2442 bp, Homo sapiens
tccgctgcccacttagagaagcagggtctaccgctctgtgcctgacaatgacgaggttgtccacagggctctcaggccggcgcgcggggctgcactcgcacctgggcaggtgggcaggcgggcaggtgggcagcggggcggcgcgcggggccgcggcaggcaggtgcggccggcaggcgcggcactttggactctgcggtgtgcgcctggggtcccggaccggggcgatcctgctgcacactcgggtaggagctttgagtccagctttctgtcaggcagttcttacagagtttgcctgactttggtttctgtttcgattctcttctcaggactttgtaaacgtaatctgcctggcggggagggagtttcctcagggagacgccaccttttggtcggggcgggtgaagagaggaggcctttggttaaggacaccgcgggaaacagaaaaggaaagcgaattctctctgacaccaagaccaacgctctagcaaagctcctccggcggatattttgttttcccagcaggttctgccttaacaataaggtcctttgtaggccaaaatgtgcagggcataaaagcatgtgatttgggactttccaaaggggaagtgaacagaaactgccacagacccggacgtgaacagggagttaccctcggctggtgaatgtaggcaggcctggctgagggtggtgagactgcgagggacaggtgagagatgaagctcagaagacatctttgcagagatgtggagaagacaggaggaagtccttcctaaaataaacctgacctcctgtgggttcccaaacactaacttgtttccctgggaatttggaggtgggttctttgaccaggacctggtaacagatgtggatggacttgaaccaccaactcagcttagaaggaagccaagacttaaagtttcctagatcccagctttttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactcta

SEQ ID NO: 375905 - DNA, 1726 bp, Homo sapiens
gcgtccgcgcctggtactcggcggcgccggattccggggctgttgggggccaggcctgggcgagcattgatcctgggctgacttggagccgcaggttttctggtcgttgaggaccctcgaggagcgtcctggtggagccgagggagtaatgtgtgtttggaaatttatttcctggaatggaggaacaagccaccctcttcttgttccagtaatcgtttgtgtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactcta

SEQ ID NO: 375906 - DNA, 1639 bp, Homo sapiens
ggctgggcctgcggaagggggcgggttcggaggagtgaactgtgcggttagtgcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagtttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactcta

SEQ ID NO: 375907 - DNA, 1640 bp, Homo sapiens
ggctgggcctgcggaagggggcgggttcggaggagtgaactgtgcggttagtgcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctgttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactcta

SEQ ID NO: 375908 - DNA, 1190 bp, Homo sapiens
tttcaaatggttactattaacctgatattcagggttttttaaaattcaaggtataagacagttatatttacctgtgctttaatgtttcagggtttttgttttgtttttcttatatttactgatggaagttatggggtcaacattactgatatttattggcttgaattataagccttggaaacaaacttttctctcttaagaaaatgctcttatggaatataattagtcaaaaataattaaaaaccattttattcttaatagataataatttcacttatgtattagtttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactcta

SEQ ID NO: 375909 - DNA, 1204 bp, Homo sapiens
tttctccctttattcactgttaaatctaattagtttaaaggcttcaaatattaaggaatataaatgataaaaacgttatgttatttttggaagtttttctcatatctctgttgccagggctattcaatcacttaatatttaattgaatatgaaattattctttttgtgtacctgggtgcactaaatatttgaaactatgtattttaaattacaataaaaaagtaatttctttgtttaaagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactcta

SEQ ID NO: 375910 - DNA, 1117 bp, Homo sapiens
ggctgggcctgcggaagggggcgggttcggaggagtgaactgtgcggttagtgcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggtaagaacattaacattctttagaatctataaagctaatctttgttctttgattagatgaacttaattgcttcaatttactaactaataaagggatgtatttttttgccagcaagttcctttgtttgttttcaaggttgtaggtaaattctgaccaaagacctcaacaaaaccattttaattatgatttttttcaaaagatgatcttccatacatgcatacattctgaatttcttctgttgtgtttaaatttatttctttgttagtacttaccagttagattgtattcttttataacttggcaggatatctaattgggagccaaagcttgcctcagtcagtcaaaagtctgtacaaaataggttttcagtggtagaaaccatgtttttgtcttttttttcttagatagtgcagaacacatagcaggtgccaaaatacatcaggatggaaaggttgcattttagagtaatttagaagtatataactttattcttatac

SEQ ID NO: 375911 - DNA, 440 bp, Homo sapiens
tgaacagggagttaccctcggctggtgaatgtaggcaggcctggctgagggtggtgagactgcgagggacaggtgagagatgaagctcagaagacatctttgcagagatgtggagaagacaggaggaagtccttcctaaaataaacctgacctcctgtgggttcccaaacactaacttgtttccctgggaatttggaggtgggttcgaaaaagtgagtaacaataaacagttaactttactgcctcatatttagattgctggtatttatgcagctttgaccaggacctggtaacagatgtggatggacttgaaccaccaactcagcttagaaggaagccaagacttaaagtttcctagatcccagcttgtaagttccctatattctttaatatacaactttcctttaataaaacaaaacaaaaaaatcccccaacaactt

SEQ ID NO: 375912 - DNA, 1996 bp, Homo sapiens
ggctgggcctgcggaagggggcgggttcggaggagtgaactgtgcggttagtgcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactctaattgttcagaaattttacatttgacttatttgacaacattaacattagtggtggctttgccattaaaaacccagtaagtattttgagtgcatctatgtgatgtggtgttttgagcatagtaggcaccacagcaacttttctgcgtggtactaaaactgccgaaaatgcgacgtagaatcaccagatctttagtgtttaatatccctggtataagatgttataattaatgtaatttctttcttggcaaacacctcatgtctgtcttagtgaagatttaataaaccacttatttttctta

SEQ ID NO: 375913 - DNA, 2347 bp, Homo sapiens
tccgctgcccacttagagaagcagggtctaccgctctgtgcctgacaatgacgaggttgtccacagggctctcaggccggcgcgcggggctgcactcgcacctgggcaggtgggcaggcgggcaggtgggcagcggggcggcgcgcggggccgcggcaggcaggtgcggccggcaggcgcggcactttggactctgcggtgtgcgcctggggtcccggaccggggcgatcctgctgcacactcgggtaggagctttgagtccagctttctgtcaggcagttcttacagagtttgcctgactttggtttctgtttcgattctcttctcaggactttgtaaacgtaatctgcctggcggggagggagtttcctcagggagacgccaccttttggtcggggcgggtgaagagaggaggcctttggttaaggacaccgcgggaaacagaaaaggaaagcgaattctctctgacaccaagaccaacgctctagcaaagctcctccggcggatattttgttttcccagcaggttctgccttaacaataaggtcctttgtaggccaaaatgtgcagggcataaaagcatgtgatttgggactttccaaaggggaagtgaacagaaactgccacagacccggacgtgaacagggagttaccctcggctggtgaatgtaggcaggcctggctgagggtggtgagactgcgagggacaggtgagagatgaagctcagaagacatctttgcagagatgtggagaagacaggaggaagtccttcctaaaataaacctgacctcctgtgggttcccaaacactaacttgtttccctgggaatttggaggtgggtttttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactcta

SEQ ID NO: 375914 - DNA, 1650 bp, Homo sapiens
gcgtccgcgcctggtactcggcggcgccggattccggggctgttgggggccaggcctgggcgagcattgatcctgggctgacttggagccgcaggttttctggtcgttgaggaccctcgaggagcgtcctggtggagccgagggatttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactcta

SEQ ID NO: 375915 - DNA, 1590 bp, Homo sapiens
ggctgggcctgcggaagggggcgggttcggaggagtgaactgtgcggttagtgcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatgaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactcta

SEQ ID NO: 375916 - DNA, 1393 bp, Homo sapiens
ggctgggcctgcggaagggggcgggttcggaggagtgaactgtgcggttagtgcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatgtatccttgaatagaaatagaaaatactagaataaagagtaattgctttctgactatcaagccagtggttagatttcagtgcctgtagtaaactagtgaatttaaaaatactttgtaagatcctgtttaaattctaggctttctagtttttatgcagaagtctgttcatataatgagtttggctaagtctacagaagcatactcatgttttagtcaatgatttagagtcagataaactcaggtatcagaatttatttttgttaataaaactatcagagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggtaagaacattaacattctttagaatctataaagctaatctttgttctttgattagatgaacttaattgcttcaatttactaactaataaagggatgtatttttttgccagcaagttcctttgtttgttttcaaggttgtaggtaaattctgaccaaagacctcaacaaaaccattttaattatgatttttttcaaaagatgatcttccatacatgcatacattctgaatttcttctgttgtgtttaaatttatttctttgttagtacttaccagttagattgtattcttttataacttggcaggatatctaattgggagccaaagcttgcctcagtcagtcaaaagtctgtacaaaataggttttcagtggtagaaaccatgtttttgtcttttttttcttagatagtgcagaacacatagcaggtgccaaaatacatcaggatggaaaggttgcattttagagtaatttagaagtatataactttattcttatac

SEQ ID NO: 375917 - DNA, 166 bp, Homo sapiens
gcggccgcctactactactactactactactgctcgaattcaagcttctaacgatgtacggggacatgttgttaagcctcacacaggtgtgctagcattgaactgtagagtgtcacatacctgagtttgaaaataaaagcacatttccaaacctcaaaaaaaaaaa

SEQ ID NO: 375918 - DNA, 6062 bp, Homo sapiens
cctctgactttgtaaacaaagccagagagccggaggaaatgaaattccaaatgccctctcctagcctggtttgacctccggtgttgatgcaaactcaagccggctctcactgtggcttgtggctccgggaaatggaacccagcttgggacagggaatggatttgacttgtccttttggcgtctccccagcctgtggagcccaggcctcttggagcatctttggggctgacgcagcggaggttccgggcacacgtggccactcccagcaggagggtgccatgccccacattcccgaggacgaggagccccccggagagtcacaggcagcccagagccctgccggccaagggtcctcctaccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcgaagcaactcacttacagtccccaccccgccagaagggggatgaagccgacgtctcttcacctcaccctggcgagcctaacgtcccaaagggcctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctttcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctcaaaaaaaaaaa

SEQ ID NO: 375919 - DNA, 6169 bp, Homo sapiens
tggcgctggcccagggtcttctccaggctcacatgcttgctggaggctccaggcgggtggggagatctgcagggtccctttgttcccgtccggccaggacagtgtccagtggcacgagttgccatggggactgccatctgctgtgtggatacccatcggaggggcccagggtgagcgactgccccaaaggcccagcctgccctgagccctgaggccagctggtcggctttccctgccattatcccccgagccaggccggagtggggctcccagaggagctctcggctctaagtcccagcccctctcagaggaggcgtgcggccgaggttctgcagccagaggcttctcggctctgagctccggagccagatgtaacattgaccttaaatggtaaaagctccccagagtgaagggaggctggccagaggaggaaaggagaataactcagttttaggggtcctcctaccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcgaagcaactcacttacagtccccaccccgccagaagggggatgaagccgacgtctcttcacctcaccctggcgagcctaacgtcccaaagggcctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctttcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctcaaaaaaaaaaa

SEQ ID NO: 375920 - DNA, 6485 bp, Homo sapiens
tggcgctggcccagggtcttctccaggctcacatgcttgctggaggctccaggcgggtggggagatctgcagggtccctttgttcccgtccggccaggacagtgtccagtggcacgagttgccatggggactgccatctgctgtgtggatacccatcggaggggcccagggtgagcgactgccccaaaggcccagcctgccctgagccctgaggccagctggtcggctttccctgccattatcccccgagccaggccggagtggggctcccagaggagctctcggctctaagtcccagcccctctcagaggaggcgtgcggccgaggttctgcagccagaggcttctcggctctgagctccggagccagatgtaacattgaccttaaatggtaaaagctccccagagtgaagggaggctggccagaggaggaaaggagaataactcagttttagacagggtctcgcactgtcacccaggctggagtgcagtggtgcaaccccacctcccgggttcaagcaattctcatgcctcagcctcccaagtagctgggattacagcctgtggagcccaggcctcttggagcatctttggggctgacgcagcggaggttccgggcacacgtggccactcccagcaggagggtgccatgccccacattcccgaggacgaggagccccccggagagtcacaggcagcccagagccctgccggccaagggtcctcctaccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcgaagcaactcacttacagtccccaccccgccaggtttggatgtgtgcagtggcccgccatcccctctgcctggagcaccaccacagaagggggatgaagccgacgtctcttcacctcaccctggcgagcctaacgtcccaaagggcctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctttcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctcaaaaaaaaaaa

SEQ ID NO: 375921 - DNA, 6203 bp, Homo sapiens
atatcctagaataacctgcctcttcggctgggaagcggagggaaccttctcttccttaaagacagggtctcgcactgtcacccaggctggagtgcagtggtgcaaccccacctcccgggttcaagcaattctcatgcctcagcctcccaagtagctgggattacagagattccatcaagaagacttctgcactgggtttgaggctctgaccatccacagtcctgggtcctattctcaactccaaaaacaccgcaaggagagtggtggacttcctctcaagaggattgggcatctgtgtctggtgaagtctttaaggaggcccaataaataacacctctttccttcactgaagctttaaggcttgttgggaattcagagactaatatcacccgtatgactgatgaagctggtgttggaaagtgtttggatcaacaggggtcctcctaccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcgaagcaactcacttacagtccccaccccgccaggtttggatgtgtgcagtggcccgccatcccctctgcctggagcaccaccacagaagggggatgaagccgacgtctcttcacctcaccctggcgagcctaacgtcccaaagggcctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctttcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctcaaaaaaaaaaa

SEQ ID NO: 375922 - DNA, 5129 bp, Homo sapiens
cctctgactttgtaaacaaagccagagagccggaggaaatgaaattccaaatgccctctcctagcctggtttgacctccggtgttgatgcaaactcaagccggctctcactgtggcttgtggctccgggaaatggaacccagcttgggacagggaatggatttgacttgtccttttggcgtctccccagcctgtggagcccaggcctcttggagcatctttggggctgacgcagcggaggttccgggcacacgtggccactcccagcaggagggtgccatgccccacattcccgaggacgaggagccccccggagagtcacaggcagcccagagccctgccggccaagggtcctcctaccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcgaagcaactcacttacagtccccaccccgccagaagggggatgaagccgacgtctcttcacctcaccctggcgagcctaacgtcccaaagggcctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctttcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcagggactgcttcagtttcgtcgacgcggccgcgaatttagtagtagtag

SEQ ID NO: 375923 - DNA, 3027 bp, Homo sapiens
cctctgactttgtaaacaaagccagagagccggaggaaatgaaattccaaatgccctctcctagcctggtttgacctccggtgttgatgcaaactcaagccggctctcactgtggcttgtggctccgggaaatggaacccagcttgggacagggaatggatttgacttgtccttttggcgtctccccagcctgtggagcccaggcctcttggagcatctttggggctgacgcagcggaggttccgggcacacgtggccactcccagcaggagggtgccatgccccacattcccgaggacgaggagccccccggagagtcacaggcagcccagagccctgccggccaagggtcctcctaccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcgaagcaactcacttacagtccccaccccgccagaagggggatgaagccgacgtctcttcacctcaccctggcgagcctaacgtcccaaagggcctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctttcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctcaaaaaaaaaaa

SEQ ID NO: 375924 - DNA, 1121 bp, Homo sapiens
gcggccactctctagaactctatttgcatcctgtctttggctctgagggcctcatgtagctaaagctccttcgagttgtatccagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctcaaaaaaaaaaa

SEQ ID NO: 375925 - DNA, 5998 bp, Homo sapiens
cctctgactttgtaaacaaagccagagagccggaggaaatgaaattccaaatgccctctcctagcctggtttgacctccggtgttgatgcaaactcaagccggctctcactgtggcttgtggctccgggaaatggaacccagcttgggacagggaatggatttgacttgtccttttggcgtctccccagcctgtggagcccaggcctcttggagcatctttggggctgacgcagcggaggttccgggcacacgtggccactcccagcaggagggtgccatgccccacattcccgaggacgaggagccccccggagagtcacaggcagcccagagccctgccggccaagggtcctcctaccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcgaagcaactcacttacagtccccaccccgccagaagggggatgaagccgacgtctcttcacctcaccctggcgagcctaacgtcccaaagggcctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctttcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctcaaaaaaaaaaa

SEQ ID NO: 375926 - DNA, 1503 bp, Homo sapiens
tggcgctggcccagggtcttctccaggctcacatgcttgctggaggctccaggcgggtggggagatctgcagggtccctttgttcccgtccggccaggacagtgtccagtggcacgagttgccatggggactgccatctgctgtgtggatacccatcggaggggcccagggtgagcgactgccccaaaggcccagcctgccctgagccctgaggccagctggtcggctttccctgccattatcccccgagccaggccggagtggggctcccagaggagctctcggctctaagtcccagcccctctcagaggaggcgtgcggccgaggttctgcagccagaggcttctcggctctgagctccggagccagatgtaacattgaccttaaatggtaaaagctccccagagtgaagggaggctggccagaggaggaaaggagaataactcagttttagacagggtctcgcactgtcacccaggctggagtgcagtggtgcaaccccacctcccgggttcaagcaattctcatgcctcagcctcccaagtagctgggattacagcctgtggagcccaggcctcttggagcatctttggggctgacgcagcggaggttccgggcacacgtggccactcccagcaggagggtgccatgccccacattcccgaggacgaggagccccccggagagtcacaggcagcccagagccctgccggccaagggtcctcctaccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcgaagcaactcacttacagtccccaccccgccaggtttggatgtgtgcagtggcccgccatcccctctgcctggagcaccaccacaggtgacaggaccccccacctgctgtgctgtttctatgccaatgggtctctccccttaccccgaacaccaggaggcccttcgtgacccactggagatgagggtgctgggtggagggcatgaacaccactgctagggggcctccttggggatatttcaagaggaaacacggtctcttcccattgctgactgactcctgttcaccttctccagcagaagggggatgaagccgacgtctcttcacctcaccctggcgagcctgtgagtttgagctttgctccctttggatgatttgagtgtggggggcac

SEQ ID NO: 375927 - DNA, 1117 bp, Homo sapiens
gtgcttatctgttcttctgtgattcaacatatattcttcgatatagtgcacgacgggctcgcattctaggttttattggccatatcaaaagtgagcacaaatcaaataactgcttgatccctctgctaccacccactgagaggagaaaagtcatttagttccaagataaccttggttccaggctagatacagaggggcccttgggacagctgtgtcaccaactctggagcagtctctggaggcaagtccagagcattaacataaaagtgtcccagtcccacagtgccccaggtcccagcacccctgctccaaccctaaccttggatacttttggccctttaacaaatcgccacctctgcttgcaggacttgatcccatgtgtgggctccaaggccttgtctggcccacaccttctttagtgtctctcacttccgtgtcctggcttcctcctggctccagatgagaatgtggtaacctaggaagagtgagaccagtctgacttacaccttctgttaccaatctctcagagcctggggctggcccgcaaacctacgatttggtaaagaaatactaggaaggccgggcgcggtggctcaagtctgtaatcccagcactttgggaggctgaggtgggcggatcacgaggtcaggagaccgagaccatcctggctaacacggtgaaaccctgtctctactaaaaatacaaaaaattagctgggcgtggtagcgggcacctgtagtcctagctactcgagaggttgaggcaggagaatggcgtgaacccaggaggcggagcttgcattgagccaagatcacgccactgcactccagcccggggggacagagcgagactccgtctcaaaaaaaaaaaagaaatactaggaaactggacagtagccaggcattgcatgaccaagacaaagccagaggaatggagggccttggctatagagaccactgtctcccagccatcttcttcgtgggccactgccctggggtgaatgtggcagggcggggctgaggctggcccgcactgaaccttgggaagtaggatcggacttggcaagtcagagacattctcctcctactcacccattgcagaggccagcgtgtccccc

SEQ ID NO: 375928 - DNA, 785 bp, Homo sapiens
  misc_feature (753)..(753): n is a, c, g, or t
  misc_feature (762)..(762): n is a, c, g, or t
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggggaagtccctggctggggctcaaanattaagggnaagaaaccctggaaccccttaaa

SEQ ID NO: 375929 - DNA, 161 bp, Homo sapiens
gcggccgcctactactactactactactactgctcgaattcaagcttctaacgatgtacggggacgttgtgagctggaaaagaaagttctagactgtggcccagaatagggctggggcagctcccagagaatgaatagtgctgtttcctattggactgata

SEQ ID NO: 375930 - DNA, 2086 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 375931 - DNA, 2024 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 375932 - DNA, 2221 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgaggcaccttcccactagggaagagagctgccccctggagaggctggcctaggcctggggcgctaacctgcctgctgcgatacacagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 375933 - DNA, 2574 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgaggtgagcccactagggtgcccactgtgatcattcttttccctctcagcaggcccaggtcaccaggacggtagaacacagtgcctgataccgtcacgcccctggggaggtccagggaggctgtgcttgtgaaacacgggaacttccctcatgggtgacagagatcctcagagtgggaaatggtttattaattgtcagcagtccctgctgctctccacccagagctcctttctgctgagtctcactttttgtgcctgagcttcctttcctgtgccctgaagcatccacaccgcctgccatgtctactggttccagcccctctgcctctctcccctctccctccctcacacacacaggcaccttcccactagggaagagagctgccccctggagaggctggcctaggcctggggcgctaacctgcctgctgcgatacacagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 375934 - DNA, 2071 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggagcaggactgagaccctgatccatttttcatagcaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 375935 - DNA, 1930 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgaggttgtgagctggaaaagaaagttctagactgtggcccagaatagggctggggcagctcccagagaatgaatagtgctgtttcctattggactgatagtgctgtttcctgtgctttttcttcatttctgagacgcaagaagctctctgaccaggtcacttctggaagatccacgcagaagctcagtcggtatggttttattggccatatcaaaagtgagcacaaatcaaataactgcttgatccctctgctaccacccactgagaggagaaaagtcatttagttccaagataaccttggttccaggctagatacagaggggcccttgggacagctgtgtcaccaactctggagcagtctctggaggcaagtccagagcattaacataaaagtgtcccagtcccacagtgccccaggtcccagcacccctgctccaaccctaaccttggatacttttggccctttaacaaatcgccacctctgcttgcaggacttgatcccatgtgtgggctccaaggccttgtctggcccacaccttctttagtgtctctcacttccgtgtcctggcttcctcctggctccagatgagaatgtggtaacctaggaagagtgagaccagtctgacttacaccttctgttaccaatctctcagagcctggggctggcccgcaaacctacgatttggtaaagaaatactaggaaggccgggcgcggtggctcaagtctgtaatcccagcactttgggaggctgaggtgggcggatcacgaggtcaggagaccgagaccatcctggctaacacggtgaaaccctgtctctactaaaaatacaaaaaattagctgggcgtggtagcgggcacctgtagtcctagctactcgagaggttgaggcaggagaatggcgtgaacccaggaggcggagcttgcattgagccaagatcacgccactgcactccagcccggggggacagagcgagactccgtctcaaaaaaaaaaaagaaatactaggaaactggacagtagccaggcattgcatgaccaagacaaagccagaggaatggagggccttggctatagagaccactgtctcccagccatcttcttcgtgggccactgccctggggtgaatgtggcagggcggggctgaggctggcccgcactgaaccttgggaagtaggatcggacttggcaagtcagagacattctcctcctactcacccattgcagaggccagcgtgtccccc

SEQ ID NO: 375936 - DNA, 786 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgaggttgtgagctggaaaagaaagttctagactgtggcccagaatagggctggggcagctcccagagaatgaatagtgctgtttcctattggactgata

SEQ ID NO: 375937 - DNA, 924 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctcccagagaatgaatagtgctgtttcctattggaaaaaaaaaaa

SEQ ID NO: 375938 - DNA, 2137 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 375939 - DNA, 3281 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgatagtgctgtttcctgtgctttttcttcatttctgagacgcaagaagctctctgaccaggtcacttctggaagatccacgcagaagctcagtcggtatggttttattggccatatcaaaagtgagcacaaatcaaataactgcttgatccctctgctaccacccactgagaggagaaaagtcatttagttccaagataaccttggttccaggctagatacagaggggcccttgggacagctgtgtcaccaactctggagcagtctctggaggcaagtccagagcattaacataaaagtgtcccagtcccacagtgccccaggtcccagcacccctgctccaaccctaaccttggatacttttggccctttaacaaatcgccacctctgcttgcaggacttgatcccatgtgtgggctccaaggccttgtctggcccacaccttctttagtgtctctcacttccgtgtcctggcttcctcctggctccagatgagaatgtggtaacctaggaagagtgagaccagtctgacttacaccttctgttaccaatctctcagagcctggggctggcccgcaaacctacgatttggtaaagaaatactaggaaggccgggcgcggtggctcaagtctgtaatcccagcactttgggaggctgaggtgggcggatcacgaggtcaggagaccgagaccatcctggctaacacggtgaaaccctgtctctactaaaaatacaaaaaattagctgggcgtggtagcgggcacctgtagtcctagctactcgagaggttgaggcaggagaatggcgtgaacccaggaggcggagcttgcattgagccaagatcacgccactgcactccagcccggggggacagagcgagactccgtctcaaaaaaaaaaaagaaatactaggaaactggacagtagccaggcattgcatgaccaagacaaagccagaggaatggagggccttggctatagagaccactgtctcccagccatcttcttcgtgggccactgccctggggtgaatgtggcagggcggggctgaggctggcccgcactgaaccttgggaagtaggatcggacttggcaagtcagagacattctcctcctactcacccattgcagaggccagcgtgtccccc

SEQ ID NO: 375940 - DNA, 3227 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgatagtgctgtttcctgtgctttttcttcatttctgagacgcaagaagctctctgaccaggtcacttctggaagatccacgcagaagctcagtcggtatggttttattggccatatcaaaagtgagcacaaatcaaataactgcttgatccctctgctaccacccactgagaggagaaaagtcatttagttccaagataaccttggttccaggctagatacagaggggcccttgggacagctgtgtcaccaactctggagcagtctctggaggcaagtccagagcattaacataaaagtgtcccagtcccacagtgccccaggtcccagcacccctgctccaaccctaaccttggatacttttggccctttaacaaatcgccacctctgcttgcaggacttgatcccatgtgtgggctccaaggccttgtctggcccacaccttctttagtgtctctcacttccgtgtcctggcttcctcctggctccagatgagaatgtggtaacctaggaagagtgagaccagtctgacttacaccttctgttaccaatctctcagagcctggggctggcccgcaaacctacgatttggtaaagaaatactaggaaggccgggcgcggtggctcaagtctgtaatcccagcactttgggaggctgaggtgggcggatcacgaggtcaggagaccgagaccatcctggctaacacggtgaaaccctgtctctactaaaaatacaaaaaattagctgggcgtggtagcgggcacctgtagtcctagctactcgagaggttgaggcaggagaatggcgtgaacccaggaggcggagcttgcattgagccaagatcacgccactgcactccagcccggggggacagagcgagactccgtctcaaaaaaaaaaaagaaatactaggaaactggacagtagccaggcattgcatgaccaagacaaagccagaggaatggagggccttggctatagagaccactgtctcccagccatcttcttcgtgggccactgccctggggtgaatgtggcagggcggggctgaggctggcccgcactgaaccttgggaagtaggatcggacttggcaagtcagagacattctcctcctactcacccattgcagaggccagcgtgtccccc

SEQ ID NO: 375941 - DNA, 2093 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcagtgtagctgaaagaagtctgatgtgcagataggctggagtcctgatggctgtcatgctgagctgtctggtttttattgacagactttcagacttgaacacctcgtgt

SEQ ID NO: 375942 - DNA, 1929 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 375943 - DNA, 2508 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggagcaggactgagaccctgatccatttttcatagcaatttctggacatggtggccaacgagacagggcttacagacctgacactggagaccgtctggaatgtctatgacacactcttctgtgaggtgagcccactagggtgcccactgtgatcattcttttccctctcagcaggcccaggtcaccaggacggtagaacacagtgcctgataccgtcacgcccctggggaggtccagggaggctgtgcttgtgaaacacgggaacttccctcatgggtgacagagatcctcagagtgggaaatggtttattaattgtcagcagtccctgctgctctccacccagagctcctttctgctgagtctcactttttgtgcctgagcttcctttcctgtgccctgaagcatccacaccgcctgccatgtctactggttccagcccctctgcctctctcccctctccctccctcacacacacaggcaccttcccactagggaagagagctgccccctggagaggctggcctaggcctggggcgctaacctgcctgctgcgatacacagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 375944 - DNA, 2059 bp, Homo sapiens
aggtgccacccagcgggttccagcttgtttgctgcatagattacaacggtgatggcgggcaagcggtccggctggagccgggcggctctcctccagctccttctcggcgtgaacctggtggtgatgccgcccacccaggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 375945 - DNA, 3533 bp, Homo sapiens
  misc_feature (1782)..(1782): n is a, c, g, or t
gcggccgtgtccctccgcggcggctgcgaggcggtgcggcggctgaggcggccgaggcggccagttgggtaccgggaggggcgaaggcgggcggcagaggcgatcagaagtttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccgggcacccagcgcttcgagctgcacaagaaggcgcaggcgtcgctgaacgccgggctggacctgcggctggccgtgcagctgcccccgggcgaggacctgaacgactgggtggctgttcacgtggtggacttctttaaccgcgtcaacctcatctacggcaccatcagcgacggctgcacggagcagtcctgccccgtcatgtcggggggccccaagtatgagtaccgctggcaggatgagcataagttccggaagcccacggcactctccgcgcccaggtacatggacctgctgatggactggatcgaggcgcagatcaacaacgaggacctcttccccaccaacgttggcactccgtttcccaagaacttcctgcagacggtgcggaagatcctgtcgcggctgttccgcgtgttcgtgcacgtctacatccaccactttgaccgcatcgcgcagatgggctccgaggcccacgtgaacacctgctacaagcacttctactatttcgtcaaggagttcggcctcatcgacaccaaggagctggagccactgaaagaaatgaccgcccggatgtgccactgagagccccgcgggtctcccggtgcccgaaccgccgctggggcctcggagacttggaggaggacgctctggaaccatcatcccgcttctctccggcctgagcatctcagggagaccaggggccgagccgctgagcaggtgttggtcctcaggagctccaaccccggacggcagatgccttcctcagtctcgagcctcagtctcccgtctgggactaaaacgtgaactctgtaattctatgtgttactagcaaccggaaaagcccactgtgtttttaaaccacttccactttccaggaggctggatggcttccagggtcactccttgccctgggtggctcccaggctcctggaacttctgcctccacctcgctggggagcccccagggctgctgtggccacagccctgcctgggcctgtctctcaagggcacccagcttgctcggcctcctacatgtctcccgttggggaggcaagaggctgaggggcttccgagcccctgagagcggacatctcctcccgcaggcctttactccgcactccccactggcagccgctggtgtctcttcacacagaggcacaacctggacccaggcagcctctttcctccctccccaatctcttccatttttctacagatttttttttttttggtcatactagagacaggggtctcgctgaactcctggcctccagtgatcctccatcctcggcctcccaaagtgctggaatcacaggggtgagccaccgcncccagccctctctcttcctcaatgcactctgcttcttccgttcttccgaaacattcagctgactgtatccagggcttcctggactcctgggaccccacgtcctgcaccccggcttctgactcatttcctaagggcccctttgtgtatcataaagggtttgatttttatagtcacatttacaaccatcttgagatttttattttttttgaacggagtctcccactgtcgcccagactggagtccagtggcacaatctcggctcactgcatcctccacctcctgggttcaagtgattctcctgcttcagcctcccaagtagctgggattacaggtgtgcgccaccacgcccaggaaattatgtagttttagtagagacaagatttcaccatgttggccaggctggtctcaaactcctgacttcaggtgatccgcctaccttggcctccaaaagtgctgggattacaggcatgagctactgcacccggcctaaccaggctggagtgcagtggtgggatctcggctcactgcaagctccgcctcccagattcacgccattctcctgcctcagcctccccagcagctgggactacaggcacccaccgtcacgcccggctaatttttttgtattttagtagagacagggtttcaccgtgttagccaggatggtcttgatctcctgaccttgtgatccaccagcctcagcctcccaaagtgctgggattacaggcgtgagccactgtgcccggccaagaatttttttatcgataacatagtgagctctctgcctcttcggaacgatgtccactttgcttatgatcaacccaagcaggactcttctctccctggacgcctctcccctggtctggaatcttccagttctgccagaattggcctttcccagatgctgcaaacttccagttgaacccctttttctgtgtggcccctggggctgcgagaccaaaatccatgagttctgtgtaccctagacctttggaaggtgagagcagggccctgagaaaaggcagccacctcctctccctggctgaacccctgccaccctactcctcaccagaattgtcagtggcctttcaccacagtggtccttcctgcctgagccctgcactgtcccagaccacacagaagtctggtcacctctgggcgcctgggatggtcaccgaagagaagcacgctgtccccgtctctcctggcttctgccagaaaatcgaacaagtgcaattaacacactgttactgccgaagcctgaaactcccaggacttgtccttgatccttccagaaaccaccaggtccggcacttggagccccccggagagggacctcccagccgagccctcaaagaactccatgaaatcaggaactgcttgatgaaatgtatctccttgtacctggaagatgaagcccaaacacccacacctctgtctcccccagggctcgggatgtctccagcagcccggccacgcagcttcccaggtgggctcggggaggtgggagcagggaccatctctgtcccctccaccctcactccatccacctcggagaccaccctcccccagccagatacggaataaaactacagacgcagacgtcggaataaaaacacaaaaacaaaaaaaaaaacactgggggcttaattagggcgcggcaaaaaggttttaaatgcctggctctctttctcgccccttttttcaaggggaatccggcccatagggccatatcaacggcctttaccgaa

SEQ ID NO: 375946 - DNA, 707 bp, Homo sapiens
cgtacatgtcatagctttccatgagtacaccccttccccacagtgagcagtgatggcccgaatgttattatgacatggtgagctctctgcctcttcggaacgatgtccactttgcttatgatcaacccaagcaggactcttctctccctggacgcctctcccctggtctggaatcttccagttctgccagaattggcctttcccagatgcctgcactgtcccagaccacacagaagtctggtcacctctgggcgcctgggatggtcaccgaagagaagcacgctgtccccgtctctcctggcttctgccagaaaatcgaacaagtgcaattaacacactgttactgccgaagcctgaaactcccaggacttgtccttgatccttccagaaaccaccaggtccggcacttggagccccccggagagggacctcccagccgagccctcaaagaactccatgaaatcaggaactgcttgatgaaatgtatctccttgtacctggaagatgaagcccaaacacccacacctctgtctcccccagggctcgggatgtctccagcagcccggccacgcagcttcccaggtgggctcggggaggtgggagcagggaccatctctgtcccctccaccctcactccatccacctcggagaccaccctcccccagccagatacggaataaaactacagacgcagacgtcggaataaa

SEQ ID NO: 375947 - DNA, 586 bp, Homo sapiens
tccgacgtttgcgtctgtagttttattccgtatctggctgggggagggtggtctccgaggtggatggagtgagggtggagggctcagccctgcactgtcccagaccacacagaagtctggtcacctctgggcgcctgggatggtcaccgaagagaagcacgctgtccccgtctctcctggcttctgccagaaaatcgaacaagtgcaattaacacactgttactgccgaagcctgaaactcccaggacttgtccttgatccttccagaaaccaccaggtccggcacttggagccccccggagagggacctcccagccgagccctcaaagaactccatgaaatcaggaactgcttgatgaaatgtatctccttgtacctggaagatgaagcccaaacacccacacctctgtctcccccagggctcgggatgtctccagcagcccggccacgcagcttcccaggtgggctcggggaggtgggagcagggaccatctctgtcccctccaccctcactccatccacctcggagaccaccctcccccagccagatacggaataaaactacagacgcagacgtcggaataaa

SEQ ID NO: 375948 - DNA, 1163 bp, Homo sapiens
gcggccgtgtccctccgcggcggctgcgaggcggtgcggcggctgaggcggccgaggcggccagttgggtaccgggaggggcgaaggcgggcggcagaggcgatcagaagtttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccgggcacccagcgcttcgagctgcacaagaaggcgcaggcgtcgctgaacgccgggctggacctgcggctggccgtgcagctgcccccgggcgaggacctgaacgactgggtggctgttcacgtggtggacttctttaaccgcgtcaacctcatctacggcaccatcagcgacggctgcacggagcagtcctgccccgtcatgtcggggggccccaagtatgagtaccgctggcaggatgagcataagttccggaagcccacggcactctccgcgcccaggtacatggacctgctgatggactggatcgaggcgcagatcaacaacgaggacctcttccccaccaacgttgtttgaccgcatcgcgcagatgggctccgaggcccacgtgaacacctgctacaagcacttctactatttcgtcaaggagttcggcctcatcgacaccaaggagctggagccactggtgcgcgggcttggggctgagggcgtgcggttacggtggggctggtggcccgtggcagaggaacccttccggggccaggaccctgactgcttgcggtcggcccagcagctggcggccccggctggagttgggccccggggaccctgctgatgggacaagtggtgaggtagctgggagggatcctgcgttctcccacggaacaaatgccggcgacaggtgcagtttcctccgcgccgccccgcgtccag

SEQ ID NO: 375949 - DNA, 3396 bp, Homo sapiens
  misc_feature (1782)..(1782): n is a, c, g, or t
gcggccgtgtccctccgcggcggctgcgaggcggtgcggcggctgaggcggccgaggcggccagttgggtaccgggaggggcgaaggcgggcggcagaggcgatcagaagtttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccgggcacccagcgcttcgagctgcacaagaaggcgcaggcgtcgctgaacgccgggctggacctgcggctggccgtgcagctgcccccgggcgaggacctgaacgactgggtggctgttcacgtggtggacttctttaaccgcgtcaacctcatctacggcaccatcagcgacggctgcacggagcagtcctgccccgtcatgtcggggggccccaagtatgagtaccgctggcaggatgagcataagttccggaagcccacggcactctccgcgcccaggtacatggacctgctgatggactggatcgaggcgcagatcaacaacgaggacctcttccccaccaacgttggcactccgtttcccaagaacttcctgcagacggtgcggaagatcctgtcgcggctgttccgcgtgttcgtgcacgtctacatccaccactttgaccgcatcgcgcagatgggctccgaggcccacgtgaacacctgctacaagcacttctactatttcgtcaaggagttcggcctcatcgacaccaaggagctggagccactgaaagaaatgaccgcccggatgtgccactgagagccccgcgggtctcccggtgcccgaaccgccgctggggcctcggagacttggaggaggacgctctggaaccatcatcccgcttctctccggcctgagcatctcagggagaccaggggccgagccgctgagcaggtgttggtcctcaggagctccaaccccggacggcagatgccttcctcagtctcgagcctcagtctcccgtctgggactaaaacgtgaactctgtaattctatgtgttactagcaaccggaaaagcccactgtgtttttaaaccacttccactttccaggaggctggatggcttccagggtcactccttgccctgggtggctcccaggctcctggaacttctgcctccacctcgctggggagcccccagggctgctgtggccacagccctgcctgggcctgtctctcaagggcacccagcttgctcggcctcctacatgtctcccgttggggaggcaagaggctgaggggcttccgagcccctgagagcggacatctcctcccgcaggcctttactccgcactccccactggcagccgctggtgtctcttcacacagaggcacaacctggacccaggcagcctctttcctccctccccaatctcttccatttttctacagatttttttttttttggtcatactagagacaggggtctcgctgaactcctggcctccagtgatcctccatcctcggcctcccaaagtgctggaatcacaggggtgagccaccgcncccagccctctctcttcctcaatgcactctgcttcttccgttcttccgaaacattcagctgactgtatccagggcttcctggactcctgggaccccacgtcctgcaccccggcttctgactcatttcctaagggcccctttgtgtatcataaagggtttgatttttatagtcacatttacaaccatcttgagatttttattttttttgaacggagtctcccactgtcgcccagactggagtccagtggcacaatctcggctcactgcatcctccacctcctgggttcaagtgattctcctgcttcagcctcccaagtagctgggattacaggtgtgcgccaccacgcccaggaaattatgtagttttagtagagacaagatttcaccatgttggccaggctggtctcaaactcctgacttcaggtgatccgcctaccttggcctccaaaagtgctgggattacaggcatgagctactgcacccggcctaaccaggctggagtgcagtggtgggatctcggctcactgcaagctccgcctcccagattcacgccattctcctgcctcagcctccccagcagctgggactacaggcacccaccgtcacgcccggctaatttttttgtattttagtagagacagggtttcaccgtgttagccaggatggtcttgatctcctgaccttgtgatccaccagcctcagcctcccaaagtgctgggattacaggcgtgagccactgtgcccggccaagaatttttttatcgataacatagtgagctctctgcctcttcggaacgatgtccactttgcttatgatcaacccaagcaggactcttctctccctggacgcctctcccctggtctggaatcttccagttctgccagaattggcctttcccagatgctgcaaacttccagttgaacccctttttctgtgtggcccctggggctgcgagaccaaaatccatgagttctgtgtaccctagacctttggaaggtgagagcagggccctgagaaaaggcagccacctcctctccctggctgaacccctgccaccctactcctcaccagaattgtcagtggcctttcaccacagtggtccttcctgcctgagccctgcactgtcccagaccacacagaagtctggtcacctctgggcgcctgggatggtcaccgaagagaagcacgctgtccccgtctctcctggcttctgccagaaaatcgaacaagtgcaattaacacactgttactgccgaagcctgaaactcccaggacttgtccttgatccttccagaaaccaccaggtccggcacttggagccccccggagagggacctcccagccgagccctcaaagaactccatgaaatcaggaactgcttgatgaaatgtatctccttgtacctggaagatgaagcccaaacacccacacctctgtctcccccagggctcgggatgtctccagcagcccggccacgcagcttcccaggtgggctcggggaggtgggagcagggaccatctctgtcccctccaccctcactccatccacctcggagaccaccctcccccagccagatacggaataaaactacagacgcagacgtcggaataaa

SEQ ID NO: 375950 - DNA, 2074 bp, Homo sapiens
  misc_feature (1782)..(1782): n is a, c, g, or t
gcggccgtgtccctccgcggcggctgcgaggcggtgcggcggctgaggcggccgaggcggccagttgggtaccgggaggggcgaaggcgggcggcagaggcgatcagaagtttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccgggcacccagcgcttcgagctgcacaagaaggcgcaggcgtcgctgaacgccgggctggacctgcggctggccgtgcagctgcccccgggcgaggacctgaacgactgggtggctgttcacgtggtggacttctttaaccgcgtcaacctcatctacggcaccatcagcgacggctgcacggagcagtcctgccccgtcatgtcggggggccccaagtatgagtaccgctggcaggatgagcataagttccggaagcccacggcactctccgcgcccaggtacatggacctgctgatggactggatcgaggcgcagatcaacaacgaggacctcttccccaccaacgttggcactccgtttcccaagaacttcctgcagacggtgcggaagatcctgtcgcggctgttccgcgtgttcgtgcacgtctacatccaccactttgaccgcatcgcgcagatgggctccgaggcccacgtgaacacctgctacaagcacttctactatttcgtcaaggagttcggcctcatcgacaccaaggagctggagccactgaaagaaatgaccgcccggatgtgccactgagagccccgcgggtctcccggtgcccgaaccgccgctggggcctcggagacttggaggaggacgctctggaaccatcatcccgcttctctccggcctgagcatctcagggagaccaggggccgagccgctgagcaggtgttggtcctcaggagctccaaccccggacggcagatgccttcctcagtctcgagcctcagtctcccgtctgggactaaaacgtgaactctgtaattctatgtgttactagcaaccggaaaagcccactgtgtttttaaaccacttccactttccaggaggctggatggcttccagggtcactccttgccctgggtggctcccaggctcctggaacttctgcctccacctcgctggggagcccccagggctgctgtggccacagccctgcctgggcctgtctctcaagggcacccagcttgctcggcctcctacatgtctcccgttggggaggcaagaggctgaggggcttccgagcccctgagagcggacatctcctcccgcaggcctttactccgcactccccactggcagccgctggtgtctcttcacacagaggcacaacctggacccaggcagcctctttcctccctccccaatctcttccatttttctacagatttttttttttttggtcatactagagacaggggtctcgctgaactcctggcctccagtgatcctccatcctcggcctcccaaagtgctggaatcacaggggtgagccaccgcncccagccctctctcttcctcaatgcactctgcttcttccgttcttccgaaacattcagctgactgtatccagggcttcctggactcctgggaccccacgtcctgcaccccggcttctgactcatttcctaagggcccctttgtgtatcataaagggtttgatttttatagtcacatttacaaccatcttgagatttttattttttttgaacggagtctcccactgtcgcccagactggagtccatgagccgagatcgcaccactgcactccagcctaggcgacagagcgaga

SEQ ID NO: 375951 - DNA, 708 bp, Homo sapiens
tgggtatacaggagccctctgttctatctttgcaacttttccacaaatctaaaactattccaaaagaaagaaggttgtttttttaaaaagcaacgctatgtacagcacaaaactatcattgtttttaaaaatatgtccacatatgtatgaatatattcattataccctaaaatgttaacagtggttctctcccgagtggtaagactgaagacgatgttcatttccttgtaccttctagatcagtggttctcaaagggtggttgccaggtcagctgcagtagcagcagcatctgggaacttgttagaaatgcagattctcaggccccaccccaaagctactgatcagacactctagaggtggggcagatgattctgatagatgcaagtttgagaacacggttctagatcacagaaactggttttgtaacaagtgccacttttatagtcacaataatagaacaatgaaacttgcaaaaggggtcagtatgttgatggatgaacagcattttaagagccaacacatgcccaaacacagtacgtgcaccaggaggcaggcgcagtctagttcaagctcacactgacctgttctgtccagtccccagccgcagccaccactaaagccagcttccatgggggtctctgggatccctacagtgataaatctcagacaaacaagtctggcatgagtttttttctttccttttgtta

SEQ ID NO: 375952 - DNA, 364 bp, Homo sapiens
ttttttttttgagacagagtccagactgtcgcccaggatggagtgcagtgtgcagtggtgcaattttggctcactgcaacctccgcctctcaggttcaagcgattctcctgcctcagcctcccgagtagccaaaaaatatacaaatcatgataccatttataaaacatttgttaactgtataaaacaaaatatttgtttaaagtaaattaaagaaaaaagaaacaaaatgatgaacaaaaaattcaaaatactacattccttaggatagaaggaaagtgattaatagagagaaacttttaggaagtactggtaagattaagtcgatttccataaaacatacatatattattattatttatattt

SEQ ID NO: 375953 - DNA, 610 bp, Homo sapiens
caggacactgtcttggcttctcccagcctatcttctgaaccacatagaagtatacagtatcagtgaagcagctagctgtaaaatgtgggctgagtagcataacacttttatctgaaaaccttcaattcatagtatctgaaagcattaatattctcagtcattaatttttccaactacaaaatgaaggcactttgcaagcatcacagacttattgtaatagttaattcttgtttttgattattgtcatcttttgggggattaaagtgttttggcatgttgggctctctaatcttttcgctactttcagaatttgtgctttcaagtgtcattgtatatgcacaggacacagttgggacatgaagataaacctcacctaatagagtagatgtcatttctgggtaaggttaactgtgggaaacagaaatgtgttcactaaggaaaccttaggtcacaacctccagtttcctgaaggaaatgccaaaaatgctccaaagacaaaaggctggaaacaaactggaatgtctctctccatctgtctgctaaggcggaaggaatgatttcatgttacattcacttcctagactttcattacagagtcaagcataatgga

SEQ ID NO: 375954 - DNA, 326 bp, Homo sapiens
accagaaaaataaatgttgggttagaaaaattgtcacaaggggctggccaggctctgtggctcacgcctgtaatcctggcactttgagaggccgaggcatgtggctcacctgaggtcaagagttcgagaccagcctggccaacatggtgaatccctgtctctactaaaaatacaaaaattagctgggcatggtggtgcgtgcctgtaattctaactactcaggagtctgagacagtagaattgcttgaacctgagaggcggagcttgcagtgagccgagtagatcgcccaactgcactccagcctgggagcaagactctgtctcga

SEQ ID NO: 375955 - DNA, 1777 bp, Homo sapiens
gaagaaatgacccaggagctgatattcatgaccctccaagagacccggcagcttgtgggcatctcagatgagccccaggcagttctgaaacccaggaccaggaaaagataagagggtgggctgaggtcacatcaccctgtaacgtttccaaaagggaactgtcaggcctctgagccgaagctcagccattgtaacccctgtgacctgcacatatatgtccaggtggcctacaggagccaagaagtctggagcagctgaaaacacaaggaagtgaaacagccaattcctgccttaactaattaacccaccttacgacattccaccattatgacgtgttcctgccctgccccaactgatcaatcgaccctgtgacattcttctggacaatgagtcccatcatctctccaccatgcaccttgtgactccctcctctgctgacaacagataaccacctttaactgtaactttccacagcctaccccagccctataaagctgcccctctcctatctcccttcgctgactctcttttcagactcagcccacttgcacccaagtgaattaacagccttgttgctcacacaaagcctgtttaggtggtcttctatacggacatgcttgacacttggtgccaaaatctgggccaggggactccttcgtgagaccggccccctgtcctggccctcattccgtgaagagatccacctgcgacctcgggtcctcagaccagcccaaggaacatctcaccaatttcaaatcggatctcctcggcttagtggctgaagactgatgctgcccgatcgcctcagaagccccttggaccatcacagatgccgagcttcgggtaactcttacggtggaggattcccagccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgcccagccaaggccatgcttccatgcaacactccttccaaatggccatcccagcatgcttccaagcaggcttcatccgttcctctggaccctcatctcttaagacctgccgcctataaaaaggattatatcttgagaccctatcctctaaaattttttccacacccaaaacaaaaaatctctgggtcaaaagtctaaaacgcttaggctggcaaccatcagatccttgcccatggtgtcctcaagcctactctcatgaaatggacaacagtacacgcatatggggccagttccacatatttggcaaccagaccagcatccaggacaacacaaagtatgttgtttgttgttagagggcttgggacatttcactctttgccagcctcagcttaatccaggagacaaagattattttccttattatctcttctgcataggatctgcaatcagaactattgaacttctccattcagaccgccactcacacctatgggaaaagggtaatgtatcatcggcttagcaacagggaatactattcgtatgatggaaaatggggacaaaaggctttggtacataaaacattattccttccttggcctaaaaactcatcgccacctacattaaagctaatatgcc

SEQ ID NO: 375956 - DNA, 1696 bp, Homo sapiens
gaagaaatgacccaggagctgatattcatgaccctccaagagacccggcagcttgtgggcatctcagatgagccccaggcagttctgaaacccaggaccaggaaaagataagagggtgggctgaggtcacatcaccctgtaacgtttccaaaagggaactgtcaggcctctgagccgaagctcagccattgtaacccctgtgacctgcacatatatgtccaggtggcctacaggagccaagaagtctggagcagctgaaaacacaaggaagtgaaacagccaattcctgccttaactaattaacccaccttacgacattccaccattatgacgtgttcctgccctgccccaactgatcaatcgaccctgtgacattcttctggacaatgagtcccatcatctctccaccatgcaccttgtgactccctcctctgctgacaacagataaccacctttaactgtaactttccacagcctaccccagccctataaagctgcccctctcctatctcccttcgctgactctcttttcagactcagcccacttgcacccaagtgaattaacagccttgttgctcacacaaagcctgtttaggtggtcttctatacggacatgcttgacacttggtgccaaaatctgggccaggggactccttcgtgagaccggccccctgtcctggccctcattccgtgaagagatccacctgcgacctcgggtcctcagaccagcccaaggaacatctcaccaatttcaaatcggatctcctcggcttagtggctgaagactgatgctgcccgatcgcctcagaagccccttggaccatcacagatgccgagcttcgggtaactcttacggtggagggatctgcaatcagaactattgaacttctccattcagaccgccactcacacctatgggaaaagggtgtccacgcagtccctggtcacacttgaagcagtccggagaaatatcagccctaccccagtaatccccagaaggaacttacacttttttttaatcttttcctacaacttcatattttataaataaaaagacaaaaatgtcaggcctgtgagctgaagcttagccattgtaacccctgtgacctgcacatatccgtccaggtggcctgcaggagccaagaagtctggagcagccgaaaaaccacaaagaagtgaaacagccagttcctgccttaactaattaacccaccttacgacattccaccattatgacttgtccaccattatgacttgttcctgccctgccccaactgatcaatcaaccctgtgacattcttctcctggacaatgagtcccatcatctctccaccatgcaccttgtgaccccctcctctgctgaggataaccacctttaactgtaactttccacgcctacccaagccctataaagctgcccctctcctatctcccttcactgactctcttttcggactcagcccacttgcacccaagtgaattaacagccttgttgctcacacaaagcctgattgggtgtcttctatacggacacgcgtgacaggaacctcaacccaaaggcagtctgatgaggtgtctaagataaaagtagcggcacaaaggcttttgtaaacagaggcgtttcatgtggttttcctttcctttccttatatgtgaaaaggtgacagaaaagaaatcttcctaaaagagtcagcca

SEQ ID NO: 375957 - DNA, 2685 bp, Homo sapiens
gaagaaatgacccaggagctgatattcatgaccctccaagagacccggcagcttgtgggcatctcagatgagccccaggcagttctgaaacccaggaccaggaaaagataagagggtgggctgaggtcacatcaccctgtaacgtttccaaaagggaactgtcaggcctctgagccgaagctcagccattgtaacccctgtgacctgcacatatatgtccaggtggcctacaggagccaagaagtctggagcagctgaaaacacaaggaagtgaaacagccaattcctgccttaactaattaacccaccttacgacattccaccattatgacgtgttcctgccctgccccaactgatcaatcgaccctgtgacattcttctggacaatgagtcccatcatctctccaccatgcaccttgtgactccctcctctgctgacaacagataaccacctttaactgtaactttccacagcctaccccagccctataaagctgcccctctcctatctcccttcgctgactctcttttcagactcagcccacttgcacccaagtgaattaacagccttgttgctcacacaaagcctgtttaggtggtcttctatacggacatgcttgacacttggtgccaaaatctgggccaggggactccttcgtgagaccggccccctgtcctggccctcattccgtgaagagatccacctgcgacctcgggtcctcagaccagcccaaggaacatctcaccaatttcaaatcggatctcctcggcttagtggctgaagactgatgctgcccgatcgcctcagaagccccttggaccatcacagatgccgagcttcgggtaactcttacggtggaggattcccagccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgcccagccaaggccatgcttccatgcaacactccttccaaatggccatcccagcatgcttccaagcaggcttcatccgttcctctggaccctcatctcttaagacctgccgcctataaaaaggattatatcttgagaccctatcctctaaaattttttccacacccaaaacaaaaaatctctgggtcaaaagtctaaaacgcttaggctggcaaccatcagatccttgcccatggtgtcctcaagcctactctcatgaaatggacaacagtacacgcatatggggccagttccacatatttggcaaccagaccagcatccaggacaacacaaagtatgttgtttgttgttagagggcttgggacatttcactctttgccagcctcagcttaatccaggagacaaagattattttccttattatctcttctgcataggatctgcaatcagaactattgaacttctccattcagaccgccactcacacctatgggaaaagggtaatgtatcatcggcttagcaacagggaatactattcgtatgatggaaaatggggacaaaaggctttggtacataaaacattattccttccttggcctaaaaactcatcgccacctacattaaagctaatatgcctgattactgtttttagagaacttattttattagggcagttccaagctcaaaaatacgctaactggcaccttgttagctacataaaaatgcaccctagacccgaaacttactagactcattataaaattttctttaaggtgtccacgcagtccctggtcacacttgaagcagtccggagaaatatcagccctaccccagtaatccccagaaggaacttacacttttttttaatcttttcctacaacttcatattttataaataaaaagacaaaaatgtcaggcctgtgagctgaagcttagccattgtaacccctgtgacctgcacatatccgtccaggtggcctgcaggagccaagaagtctggagcagccgaaaaaccacaaagaagtgaaacagccagttcctgccttaactaattaacccaccttacgacattccaccattatgacttgtccaccattatgacttgttcctgccctgccccaactgatcaatcaaccctgtgacattcttctcctggacaatgagtcccatcatctctccaccatgcaccttgtgaccccctcctctgctgaggataaccacctttaactgtaactttccacgcctacccaagccctataaagctgcccctctcctatctcccttcactgactctcttttcggactcagcccacttgcacccaagtgaattaacagccttgttgctcacacaaagcctgattgggtgtcttctatacggacacgcgtgacaggaacctcaacccaaaggcagtctgatgaggtgtctaagataaaagtagcggcacaaaggcttttgtaaacagaggcgtttcatgtggttttcctttcctttccttatatgtgaaaaggtgacagaaaagaaatcttcctaaaagagtcagcca

SEQ ID NO: 375958 - DNA, 2109 bp, Homo sapiens
gaagaaatgacccaggagctgatattcatgaccctccaagagacccggcagcttgtgggcatctcagatgagccccaggcagttctgaaacccaggaccaggaaaagataagagggtgggctgaggtcacatcaccctgtaacgtttccaaaagggaactgtcaggcctctgagccgaagctcagccattgtaacccctgtgacctgcacatatatgtccaggtggcctacaggagccaagaagtctggagcagctgaaaacacaaggaagtgaaacagccaattcctgccttaactaattaacccaccttacgacattccaccattatgacgtgttcctgccctgccccaactgatcaatcgaccctgtgacattcttctggacaatgagtcccatcatctctccaccatgcaccttgtgactccctcctctgctgacaacagataaccacctttaactgtaactttccacagcctaccccagccctataaagctgcccctctcctatctcccttcgctgactctcttttcagactcagcccacttgcacccaagtgaattaacagccttgttgctcacacaaagcctgtttaggtggtcttctatacggacatgcttgacacttggtgccaaaatctgggccaggggactccttcgtgagaccggccccctgtcctggccctcattccgtgaagagatccacctgcgacctcgggtcctcagaccagcccaaggaacatctcaccaatttcaaatcggatctcctcggcttagtggctgaagactgatgctgcccgatcgcctcagaagccccttggaccatcacagatgccgagcttcgggtaactcttacggtggaggattcccagccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgcccagccaaggccatgcttccatgcaacactccttccaaatggccatcccagcatgcttccaagcaggcttcatccgttcctctggaccctcatctcttaagacctgccgcctataaaaaggattatatcttgagaccctatcctctaaaattttttccacacccaaaacaaaaaatctctgggtcaaaagtctaaaacgcttaggctggcaaccatcagatccttgcccatggtgtcctcaagcctactctcatgaaatggacaacagtacacgcatatggggccagttccacatatttggcaaccagaccagcatccaggacaacacaaagatctgcaatcagaactattgaacttctccattcagaccgccactcacacctatgggaaaagggtggcctgcaggagccaagaagtctggagcagccgaaaaaccacaaagaagtgaaacagccagttcctgccttaactaattaacccaccttacgacattccaccattatgacttgtccaccattatgacttgttcctgccctgccccaactgatcaatcaaccctgtgacattcttctcctggacaatgagtcccatcatctctccaccatgcaccttgtgaccccctcctctgctgaggataaccacctttaactgtaactttccacgcctacccaagccctataaagctgcccctctcctatctcccttcactgactctcttttcggactcagcccacttgcacccaagtgaattaacagccttgttgctcacacaaagcctgattgggtgtcttctatacggacacgcgtgacaggaacctcaacccaaaggcagtctgatgaggtgtctaagataaaagtagcggcacaaaggcttttgtaaacagaggcgtttcatgtggttttcctttcctttccttatatgtgaaaaggtgacagaaaagaaatcttcctaaaagagtcagcca

SEQ ID NO: 375959 - DNA, 1583 bp, Homo sapiens
gaagaaatgacccaggagctgatattcatgaccctccaagagacccggcagcttgtgggcatctcagatgagccccaggcagttctgaaacccaggaccaggaaaagataagagggtgggctgaggtcacatcaccctgtaacgtttccaaaagggaactgtcaggcctctgagccgaagctcagccattgtaacccctgtgacctgcacatatatgtccaggtggcctacaggagccaagaagtctggagcagctgaaaacacaaggaagtgaaacagccaattcctgccttaactaattaacccaccttacgacattccaccattatgacgtgttcctgccctgccccaactgatcaatcgaccctgtgacattcttctggacaatgagtcccatcatctctccaccatgcaccttgtgactccctcctctgctgacaacagataaccacctttaactgtaactttccacagcctaccccagccctataaagctgcccctctcctatctcccttcgctgactctcttttcagactcagcccacttgcacccaagtgaattaacagccttgttgctcacacaaagcctgtttaggtggtcttctatacggacatgcttgacacttggtgccaaaatctgggccaggggactccttcgtgagaccggccccctgtcctggccctcattccgtgaagagatccacctgcgacctcgggtcctcagaccagcccaaggaacatctcaccaatttcaaatcggatctcctcggcttagtggctgaagactgatgctgcccgatcgcctcagaagccccttggaccatcacagatgccgagcttcgggtaactcttacggtggaggattcccagccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgcccagccaaggccatgcttccatgcaacactccttccaaatggccatcccagcatgcttccaagcaggcttcatccgttcctctggaccctcatctcttaagacctgccgcctataaaaaggattatatcttgagaccctatcctctaaaattttttccacacccaaaacaaaaaatctctgggtcaaaagtctaaaacgcttaggctggcaaccatcagatccttgcccatggtgtcctcaagcctactctcatgaaatggacaacagtacacgcatatggggccagttccacatatttggcaaccagaccagcatccaggacaacacaaagtatgttgtttgttgttagagggcttgggacatttcactctttgccagcctcagcttaatccaggattcagaatgagacggggatactctagaatcaactatcacgaa

SEQ ID NO: 375960 - DNA, 2497 bp, Homo sapiens
  misc_feature (510)..(510): n is a, c, g, or t
  misc_feature (647)..(647): n is a, c, g, or t
actccagcctctctcgctaccctccaatctccctgtccagtctttttcttctctagtagagacaaaggagacacattttatccgtggacccaaaactctggcgctggtcacagactcaggaagacagtcttcccttggtgtctaatcactgcggggacgcctgcctaattattcacccacattccactggtgtctgatcaccttggggatgcctgccttggtcattcacccacattcccatggtggcaagtcatttgcggggacgcctgctttggctgctcacccccgcccttctccgtgtctctacttttctctttaaacttacctccttcactttgggcaatcttccgccctccattcctccctcttcccccttagcctgtgtacttaaaaacttctcttaaactaacacctgatataaaactcaaacgtcttattttcttctgcaattactgcttggccgcaatataaacttgacaatggttccaaatggccagaaaacggcacttntgatttctccatcctacaacccatttcaattttatatggatgcaccttcttactcagccacaatcttgttccagacaccagccccctgggcaactatcttccagtcctctagcaggctagacaggaaatttgccaanctgctaatcttctcttgcctactccagattcccagccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgcccagccaaggccatgcttccatgcaacactccttccaaatggccatcccagcatgcttccaagcaggcttcatccgttcctctggaccctcatctcttaagacctgccgcctataaaaaggattatatcttgagaccctatcctctaaaattttttccacacccaaaacaaaaaatctctgggtcaaaagtctaaaacgcttaggctggcaaccatcagatccttgcccatggtgtcctcaagcctactctcatgaaatggacaacagtacacgcatatggggccagttccacatatttggcaaccagaccagcatccaggacaacacaaagtatgttgtttgttgttagagggcttgggacatttcactctttgccagcctcagcttaatccaggagacaaagattattttccttattatctcttctgcataggatctgcaatcagaactattgaacttctccattcagaccgccactcacacctatgggaaaagggtaatgtatcatcggcttagcaacagggaatactattcgtatgatggaaaatggggacaaaaggctttggtacataaaacattattccttccttggcctaaaaactcatcgccacctacattaaagctaatatgcctgattactgtttttagagaacttattttattagggcagttccaagctcaaaaatacgctaactggcaccttgttagctacataaaaatgcaccctagacccgaaacttactagactcattataaaattttctttaaggtgtccacgcagtccctggtcacacttgaagcagtccggagaaatatcagccctaccccagtaatccccagaaggaacttacacttttttttaatcttttcctacaacttcatattttataaataaaaagacaaaaatgtcaggcctgtgagctgaagcttagccattgtaacccctgtgacctgcacatatccgtccaggtggcctgcaggagccaagaagtctggagcagccgaaaaaccacaaagaagtgaaacagccagttcctgccttaactaattaacccaccttacgacattccaccattatgacttgtccaccattatgacttgttcctgccctgccccaactgatcaatcaaccctgtgacattcttctcctggacaatgagtcccatcatctctccaccatgcaccttgtgaccccctcctctgctgaggataaccacctttaactgtaactttccacgcctacccaagccctataaagctgcccctctcctatctcccttcactgactctcttttcggactcagcccacttgcacccaagtgaattaacagccttgttgctcacacaaagcctgattgggtgtcttctatacggacacgcgtgacaggaacctcaacccaaaggcagtctgatgaggtgtctaagataaaagtagcggcacaaaggcttttgtaaacagaggcgtttcatgtggttttcctttcctttccttatatgtgaaaaggtgacagaaaagaaatcttcctaaaagagtcagcca

SEQ ID NO: 375961 - DNA, 1613 bp, Homo sapiens
agaaggacccgctgctggagaaagaaccagagcggcccccccaggaggtccgggagccggcccagaagaggcggtcccccggaggacgcgccatccttcgaagcgcacgatggcgcatcccagcatgcttccaagcaggcttcatccgttcctctggaccctcatctcttaagacctgccgcctataaaaaggattatatcttgagaccctatcctctaaaattttttccacacccaaaacaaaaaatctctgggtcaaaagtctaaaacgcttaggctggcaaccatcagatccttgcccatggtgtcctcaagcctactctcatgaaatggacaacagtacacgcatatggggccagttccacatatttggcaaccagaccagcatccaggacaacacaaagtatgttgtttgttgttagagggcttgggacatttcactctttgccagcctcagcttaatccaggagacaaagattattttccttattatctcttctgcataggatctgcaatcagaactattgaacttctccattcagaccgccactcacacctatgggaaaagggtaatgtatcatcggcttagcaacagggaatactattcgtatgatggaaaatggggacaaaaggctttggtacataaaacattattccttccttggcctaaaaactcatcgccacctacattaaagctaatatgcctgattactgtttttagagaacttattttattagggcagttccaagctcaaaaatacgctaactggcaccttgttagctacataaaaatgcaccctagacccgaaacttactagactcattataaaattttctttaaggtgtccacgcagtccctggtcacacttgaagcagtccggagaaatatcagccctaccccagtaatccccagaaggaacttacacttttttttaatcttttcctacaacttcatattttataaataaaaagacaaaaatgtcaggcctgtgagctgaagcttagccattgtaacccctgtgacctgcacatatccgtccaggtggcctgcaggagccaagaagtctggagcagccgaaaaaccacaaagaagtgaaacagccagttcctgccttaactaattaacccaccttacgacattccaccattatgacttgtccaccattatgacttgttcctgccctgccccaactgatcaatcaaccctgtgacattcttctcctggacaatgagtcccatcatctctccaccatgcaccttgtgaccccctcctctgctgaggataaccacctttaactgtaactttccacgcctacccaagccctataaagctgcccctctcctatctcccttcactgactctcttttcggactcagcccacttgcacccaagtgaattaacagccttgttgctcacacaaagcctgattgggtgtcttctatacggacacgcgtgacaggaacctcaacccaaaggcagtctgatgaggtgtctaagataaaagtagcggcacaaaggcttttgtaaacagaggcgtttcatgtggttttcctttcctttccttatatgtgaaaaggtgacagaaaagaaatcttcctaaaagagtcagcca

SEQ ID NO: 375962 - DNA, 1969 bp, Homo sapiens
gaagaaatgacccaggagctgatattcatgaccctccaagagacccggcagcttgtgggcatctcagatgagccccaggcagttctgaaacccaggaccaggaaaagataagagggtgggctgaggtcacatcaccctgtaacgtttccaaaagggaactgtcaggcctctgagccgaagctcagccattgtaacccctgtgacctgcacatatatgtccaggtggcctacaggagccaagaagtctggagcagctgaaaacacaaggaagtgaaacagccaattcctgccttaactaattaacccaccttacgacattccaccattatgacgtgttcctgccctgccccaactgatcaatcgaccctgtgacattcttctggacaatgagtcccatcatctctccaccatgcaccttgtgactccctcctctgctgacaacagataaccacctttaactgtaactttccacagcctaccccagccctataaagctgcccctctcctatctcccttcgctgactctcttttcagactcagcccacttgcacccaagtgaattaacagccttgttgctcacacaaagcctgtttaggtggtcttctatacggacatgcttgacacttggtgccaaaatctgggccaggggactccttcgtgagaccggccccctgtcctggccctcattccgtgaagagatccacctgcgacctcgggtcctcagaccagcccaaggaacatctcaccaatttcaaatcggatctcctcggcttagtggctgaagactgatgctgcccgatcgcctcagaagccccttggaccatcacagatgccgagcttcgggtaactcttacggtggagggatctgcaatcagaactattgaacttctccattcagaccgccactcacacctatgggaaaagggtaatgtatcatcggcttagcaacagggaatactattcgtatgatggaaaatggggacaaaaggctttggtacataaaacattattccttccttggcctaaaaactcatcgccacctacattaaagctaatatgcctgattactgtttttagagaacttattttattagggcagttccaagctcaaaaatacgctaactggcaccttgttagctacataaaaatgcaccctagacccgaaacttactagactcattataaaattttctttaaggtgtccacgcagtccctggtcacacttgaagcagtccggagaaatatcagccctaccccagtaatccccagaaggaacttacacttttttttaatcttttcctacaacttcatattttataaataaaaagacaaaaatgtcaggcctgtgagctgaagcttagccattgtaacccctgtgacctgcacatatccgtccaggtggcctgcaggagccaagaagtctggagcagccgaaaaaccacaaagaagtgaaacagccagttcctgccttaactaattaacccaccttacgacattccaccattatgacttgtccaccattatgacttgttcctgccctgccccaactgatcaatcaaccctgtgacattcttctcctggacaatgagtcccatcatctctccaccatgcaccttgtgaccccctcctctgctgaggataaccacctttaactgtaactttccacgcctacccaagccctataaagctgcccctctcctatctcccttcactgactctcttttcggactcagcccacttgcacccaagtgaattaacagccttgttgctcacacaaagcctgattgggtgtcttctatacggacacgcgtgacaggaacctcaacccaaaggcagtctgatgaggtgtctaagataaaagtagcggcacaaaggcttttgtaaacagaggcgtttcatgtggttttcctttcctttccttatatgtgaaaaggtgacagaaaagaaatcttcctaaaagagtcagcca

SEQ ID NO: 375963 - DNA, 1471 bp, Homo sapiens
gcgaacgtgttatccctcgcgaacgtgttatctctcgcgaacgtgttatccctcgcgaacgtgttatctctcgcgaacgtgttatccctcggcgaacgtgttgatccctcgcgtaacgtgttatctctcgacgaacgtgttatccctcgcggaacgtgttatcccttggcgaacgtgttatccctcgcgaacgtgttatccctcgcgaacgtgttatccctcgcgaacgtgttatctctcgcgaacgtgttatccctcgcgaacgtgttatccattagctctagacaaggtagagccgagaccgactcagaagccccttggaccatcacagatgccgagcttcgggtaactcttacggtggagggatctgcaatcagaactattgaacttctccattcagaccgccactcacacctatgggaaaagggtaatgtatcatcggcttagcaacagggaatactattcgtatgatggaaaatggggacaaaaggctttggtacataaaacattattccttccttggcctaaaaactcatcgccacctacattaaagctaatatgcctgattactgtttttagagaacttattttattagggcagttccaagctcaaaaatacgctaactggcaccttgttagctacataaaaatgcaccctagacccgaaacttactagactcattataaaattttctttaaggtgtccacgcagtccctggtcacacttgaagcagtccggagaaatatcagccctaccccagtaatccccagaaggaacttacacttttttttaatcttttcctacaacttcatattttataaataaaaagacaaaaatgtcaggcctgtgagctgaagcttagccattgtaacccctgtgacctgcacatatccgtccaggtggcctgcaggagccaagaagtctggagcagccgaaaaaccacaaagaagtgaaacagccagttcctgccttaactaattaacccaccttacgacattccaccattatgacttgtccaccattatgacttgttcctgccctgccccaactgatcaatcaaccctgtgacattcttctcctggacaatgagtcccatcatctctccaccatgcaccttgtgaccccctcctctgctgaggataaccacctttaactgtaactttccacgcctacccaagccctataaagctgcccctctcctatctcccttcactgactctcttttcggactcagcccacttgcacccaagtgaattaacagccttgttgctcacacaaagcctgattgggtgtcttctatacggacacgcgtgacaggaacctcaacccaaaggcagtctgatgaggtgtctaagataaaagtagcggcacaaaggcttttgtaaacagaggcgtttcatgtggttttcctttcctttccttatatgtgaaaaggtgacagaaaagaaatcttcctaaaagagtcagcca

SEQ ID NO: 375964 - DNA, 404 bp, Homo sapiens
  misc_feature (57)..(57): n is a, c, g, or t
tgcttggccgcaatataaacttgacaatggttccaaatggccagaaaacggcacttntgatttctccatcctacaagacctagatcatttttgtcaaaaaatgggcacatggtctgaggtgccttgcgtccaggcattttttacacttcgctccctcccaagcctctgctcccaatgtgactcatcccaaatttttcttctttctctcccgtccgttccttcagtctctaccccaacctcagagtcccctgaatcccccttttctgcagacccctctgacctctctccccctccccaggccactccttggcaggctgaatcaagtcccaattcttcctcagcctccgctcccccatcttataattcttctatcacctcccctcctcaaacttggtcaggcttag

SEQ ID NO: 375965 - DNA, 518 bp, Homo sapiens
  misc_feature (453)..(453): n is a, c, g, or t
taaatatctcctggtttgggccaataccttcaccggatgggtcgaggcctttcccactagctctgaaaggctactacagtcatttcttcccttctgacagatataatcccccaatttggcctccctacttccacagtttctcaggctcttggtattcagtggaaacttcataccccctaccgtcctcaatcttcaggaaaggtagaacggatgaatggtcttttaaaaacacacctcaccaagctcagcctccaacttaaaaaggactggacagtacttttaccacttgccctcctcagaattagggcctgtccttgagaagccacagggtacaacccatttcaattttatatggatgcaccttcttactcagccacaatcttgttccagacaccagccccctgggcaactatcttccagtcctctagcaggctagacaggaaatttgccaanctgctaatcttctcttgcctactccagattcccagccatatgaagacaccctagctggacgatca

SEQ ID NO: 375966 - DNA, 2582 bp, Homo sapiens
gaagaaatgacccaggagctgatattcatgaccctccaagagacccggcagcttgtgggcatctcagatgagccccaggcagttctgaaacccaggaccaggaaaagataagagggtgggctgaggtcacatcaccctgtaacgtttccaaaagggaactgtcaggcctctgagccgaagctcagccattgtaacccctgtgacctgcacatatatgtccaggtggcctacaggagccaagaagtctggagcagctgaaaacacaaggaagtgaaacagccaattcctgccttaactaattaacccaccttacgacattccaccattatgacgtgttcctgccctgccccaactgatcaatcgaccctgtgacattcttctggacaatgagtcccatcatctctccaccatgcaccttgtgactccctcctctgctgacaacagataaccacctttaactgtaactttccacagcctaccccagccctataaagctgcccctctcctatctcccttcgctgactctcttttcagactcagcccacttgcacccaagtgaattaacagccttgttgctcacacaaagcctgtttaggtggtcttctatacggacatgcttgacacttggtgccaaaatctgggccaggggactccttcgtgagaccggccccctgtcctggccctcattccgtgaagagatccacctgcgacctcgggtcctcagaccagcccaaggaacatctcaccaatttcaaatcggatctcctcggcttagtggctgaagactgatgctgcccgatcgcctcagaagccccttggaccatcacagatgccgagcttcgggtaactcttacggtggaggattcccagccatatgaagacaccctagctggacgatcagtccttgtcaaaagtctgacccctcaaactctacagcctcaatggaccagaccctacccggtcatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgcccagccaaggccatgcttccatgcaacactccttccaaatggccatcccagcatgcttccaagcaggcttcatccgttcctctggaccctcatctcttaagacctgccgcctataaaaaggattatatcttgagaccctatcctctaaaattttttccacacccaaaacaaaaaatctctgggtcaaaagtctaaaacgcttaggctggcaaccatcagatccttgcccatggtgtcctcaagcctactctcatgaaatggacaacagtacacgcatatggggccagttccacatatttggcaaccagaccagcatccaggacaacacaaagatctgcaatcagaactattgaacttctccattcagaccgccactcacacctatgggaaaagggtaatgtatcatcggcttagcaacagggaatactattcgtatgatggaaaatggggacaaaaggctttggtacataaaacattattccttccttggcctaaaaactcatcgccacctacattaaagctaatatgcctgattactgtttttagagaacttattttattagggcagttccaagctcaaaaatacgctaactggcaccttgttagctacataaaaatgcaccctagacccgaaacttactagactcattataaaattttctttaaggtgtccacgcagtccctggtcacacttgaagcagtccggagaaatatcagccctaccccagtaatccccagaaggaacttacacttttttttaatcttttcctacaacttcatattttataaataaaaagacaaaaatgtcaggcctgtgagctgaagcttagccattgtaacccctgtgacctgcacatatccgtccaggtggcctgcaggagccaagaagtctggagcagccgaaaaaccacaaagaagtgaaacagccagttcctgccttaactaattaacccaccttacgacattccaccattatgacttgtccaccattatgacttgttcctgccctgccccaactgatcaatcaaccctgtgacattcttctcctggacaatgagtcccatcatctctccaccatgcaccttgtgaccccctcctctgctgaggataaccacctttaactgtaactttccacgcctacccaagccctataaagctgcccctctcctatctcccttcactgactctcttttcggactcagcccacttgcacccaagtgaattaacagccttgttgctcacacaaagcctgattgggtgtcttctatacggacacgcgtgacaggaacctcaacccaaaggcagtctgatgaggtgtctaagataaaagtagcggcacaaaggcttttgtaaacagaggcgtttcatgtggttttcctttcctttccttatatgtgaaaaggtgacagaaaagaaatcttcctaaaagagtcagcca

SEQ ID NO: 375967 - DNA, 279 bp, Homo sapiens
tttcttcctcatccttacttggtatttccccttgcagagtccctttcacctttgtaggtcttggtcttgcccttctggaacatactgtgtggtagaactgtgggagatgtgtatcaaacaagccatactttaccttctgattctgtgtgttgaacttcgcctcacgtgctgataatgggcaagtttaataatttaggttctgtcagaaaaacaaagtatactagttatcttaatagagagatttcaatatgggaaattgggtaaatgctgttggacaac

SEQ ID NO: 375968 - DNA, 462 bp, Homo sapiens
gccagaagtgaaaaaattgagaaagtccaagcctccagggaaatggagtgaggctctaaaagcattaatctaaagggcaggataggagctttgctattgaggagacctccagacagatgcctgcaagcacctttgtagtcgtaagcactgctttgctgtgtaaaccattcttggtcaacatcctaacttgatctcactcccacctgccttacctgtggaaagcccttttctccttcaagactgaaaaaactgtgctttccttgaaatggtatttgtaatcaataaggggtaaaaattaaatactgcgcaactagattcatgaaagcagaatacatagaacaagagcatattcaatacaggcaaagcatgtgttcacagatttgctcctgtgaatggagaaaaatgaaatataattttttaaattggcagtaaaatcaaaagtttattataattagtactatt

SEQ ID NO: 375969 - DNA, 543 bp, Homo sapiens
cgatgagctgagaaaaaaaattacaaaaaaaaatcataatgttttaagaaagtttacgaatttgtgttgggccacattcaaagccattctgggcatgggttggacaagcttgttctaaagggatttttagggtgttgaaaacctaacaaagtcatttggaagactaagtgggtgaaattgtgcactcaaaattaaaagatgagattctcacagtcacatattgaaaacaattataagctaataatagcatggtgtacaagaaagatgttgcctagaaggcccagaaatagaccttagtacatgaaaatatttagtgtatgattaaggtagaatttcaagtcagttggggaaaatggataaatagccaggtagtgctgtaataacaattaactatttggggagaaaattaagttagatagctctatcttcaaccatataccacaataaattgtagatgaattaatgaactattttctgggaaacttatttaaatatgcaagttaaaaaatagaagctataaagattgctagatatgactatcta

SEQ ID NO: 375970 - DNA, 293 bp, Homo sapiens
ctcccgagtagctgggactacaggtgcccactaccacgcccagctaatttttgtatctttagtagagacggggtttcaccatgttggccaggctggtcttgaactcctgacttaggtcatctgcccaccttggcctcccaaagtgctgggattatggtcatgagccaccatgcccagcctgcataccttttttttattgttgccttttgtttttatgcctgtagcttttacattacattaaacagtttttgaaaattgtcagactgttaataacattagttttatcttgtttg

SEQ ID NO: 375971 - DNA, 2065 bp, Homo sapiens
gaaagaaatgattcatttcctacttacagactttttaaagccacattcagtattctcactacctctaggttttgctaacatctactttggttagcactagaaaatttaattttttttgtcaggaaagcacagtaataaattgcctactgttgcctaccacaataatgaaagtctgaaataagtaggaaatgcattaagttacccacatgtccagagtaggcaaatctatagagacagaaagattagtgattgcttagaaatggaaatatgaggctgggtgccgtggctcacacctgtaaccccagcactttgggaggccgaggcgggtggatcatgaggtcaggagatcgagaccatcctggccaacatggggaaaccccgtttctactaaaaatacaaaaaattagccgggcgtgatggcagatgcctgtagtcccagctacttgggaggctgaggcagaagaatggcatgaacccgggaggcggagcttgcagtgagctgagatcgtgccactgcactccagcctgggtgacagagcaagactccgtctcaaaaaaaaaaaaaaagaaatggaaatatgagggtgaggacccagtgaatgacaggtaatgagtatggagtttcttttaagggagacaaaaatgttctaacattgattgtggtgatggttgcacaatcctgtgagtatactaaaatccaatgaattatatactttaaatgggtgaattatatggtatgtgaattacatctcgaagtcattttttttaaatgatggggaaatcaaagtctgaaaataagacctgcttaaaagaaattttgacagtcgatgttgatattaactactttttcctgaaataataaaccataatccttttccagaccttcatcctcttttcctaatacattttccagagaaagcaatggaatttgagaagatggctaagttcagatttatacaaactagatagaaactttgataatagtttgcaactgttgatattttctatcagatagaatactgaaattatcctcagtagtaggcttttcctctttgtgaggaaggaaacattggtagattttgttacttatcttctatagaaaatgactatagttatacagatgaaaagctgtactttgactacaaaagggaatgcaggagttattgttgggtgctacttagttacagcatactcccatttcatatcccctccagttaaaagctttgagattcatctagaacattactccaggtgactgacactcttaaacattgagcccattttcctgtatctagtgctgtttggcgatattcttctggactgtaaggaaaaaatggatttggccatacagtatcacatagatggattgtttttgctgtggtctatgaaaatgagccacatgctatcttttatttatttgtttggttatttttacagcttatctcactttggtggaagtcttcttgggctttcaattttaaagttttagctaattggatgtcttggacctgttttatttcagggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtaggaatcctggaggaactcttcccaaagagttttgaataagttattaaatcatttatttcagttacaacaccatgttgtaactttagtaaactaagtggtatacagatgcccaaggtttgttctgtggtcatgtgaaaaaattgtcagtcatttttagcatagaaaacttgagaattattctttcaagccaaaaatgttttacagtagaacttggatcaagaaaagaggtactaggctgggtgcagtggctgacacctgtaatcccagcactttgggaggcctaggcaagaggatcgcttgagcccagcagttggagaccagcctgggcaacagcaagaccctgtctctattaaaaaaaaaaaa

SEQ ID NO: 375972 - DNA, 9762 bp, Homo sapiens
  misc_feature (7619)..(7619): n is a, c, g, or t
  misc_feature (7690)..(7690): n is a, c, g, or t
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375973 - DNA, 9219 bp, Homo sapiens
  misc_feature (7076)..(7076): n is a, c, g, or t
  misc_feature (7147)..(7147): n is a, c, g, or t
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacagataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375974 - DNA, 9460 bp, Homo sapiens
  misc_feature (7317)..(7317): n is a, c, g, or t
  misc_feature (7388)..(7388): n is a, c, g, or t
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatgggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375975 - DNA, 9436 bp, Homo sapiens
  misc_feature (7293)..(7293): n is a, c, g, or t
  misc_feature (7364)..(7364): n is a, c, g, or t
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375976 - DNA, 9310 bp, Homo sapiens
  misc_feature (7167)..(7167): n is a, c, g, or t
  misc_feature (7238)..(7238): n is a, c, g, or t
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttggtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375977 - DNA, 6674 bp, Homo sapiens
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375978 - DNA, 6623 bp, Homo sapiens
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375979 - DNA, 10201 bp, Homo sapiens
  misc_feature (8058)..(8058): n is a, c, g, or t
  misc_feature (8129)..(8129): n is a, c, g, or t
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggtaagtttaatatgctactgaagcacatttttgttctttgtggaatgatatgccaaagtgtgcagttaggaacttgttctttttatattctgaaaggttggtcacctgatctctttatgcgtttgtttctccatttgcaaaatagaggggtataatacttttgataaactattttgagatttctactgtggaccatagtcacagtgactacactaaggtactaaaccattagcctaatgagaaggcttcctaaggacatgcaggtttttagggaaatggtgtcttatttttgtgaaagattggactcaaaggataacttaatttggtttagtgacttttcagtttgaactttaacctctggactttaatgtgctcatcagcttaagttttatttggcctctttcattatatatttacataattctatttcctgctgtaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375980 - DNA, 9666 bp, Homo sapiens
  misc_feature (7523)..(7523): n is a, c, g, or t
  misc_feature (7594)..(7594): n is a, c, g, or t
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375981 - DNA, 7643 bp, Homo sapiens
  misc_feature (5500)..(5500): n is a, c, g, or t
  misc_feature (5571)..(5571): n is a, c, g, or t
atatcgtcgacccacgcgtccgattctcacttatttgtgggatctaaaaatcaaaacaatggaactcctagacacagatagcagaaggattgttaccagaggctgggaagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375982 - DNA, 7562 bp, Homo sapiens
  misc_feature (5419)..(5419): n is a, c, g, or t
  misc_feature (5490)..(5490): n is a, c, g, or t
ctgctttaacaatagcagcatctcttgaggaaggcacagggggagcattaacatctgctcctttatcaagaagaactcttccaacctctgcataccctccagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375983 - DNA, 5766 bp, Homo sapiens
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttgggagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtaggaatcctggaggaactcttcccaaagagttttgaataagttattaaatcatttatttcagttacaacaccatgttgtaactttagtaaactaagtggtatacagatgcccaaggtttgttctgtggtcatgtgaaaaaattgtcagtcatttttagcatagaaaacttgagaattattctttcaagccaaaaatgttttacagtagaacttggatcaagaaaagaggtactaggctgggtgcagtggctgacacctgtaatcccagcactttgggaggcctaggcaagaggatcgcttgagcccagcagttggagaccagcctgggcaacagcaagaccctgtctctattaaaaaaaaaaaa

SEQ ID NO: 375984 - DNA, 7433 bp, Homo sapiens
  misc_feature (5290)..(5290): n is a, c, g, or t
  misc_feature (5361)..(5361): n is a, c, g, or t
tttgtgggcacaaaaggaatccctcatctggtgactcatgatgcccgcaccacccgctaccccgatcccctcatcaaggtgaatgataccattcagattgatttagagactggcaagattactgatttcatcaagttcgacactggtaacctgtgtatggtgactggaggtgagatcacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375985 - DNA, 7381 bp, Homo sapiens
  misc_feature (5238)..(5238): n is a, c, g, or t
  misc_feature (5309)..(5309): n is a, c, g, or t
ggctgtgttgatctagaggatcccgggaaactctgagtggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375986 - DNA, 4888 bp, Homo sapiens
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgcctgcgacactttatcgtgctgacgtgaatgctcaatcgagcaggttatgcggtaagtgcaaaaggcatgacataagacctaaatcagacacactggatggctgtgcgtcctttgtgtgttactggaagtaggagtgggactactggatgggtgagttttgagctcccgggggtgctgc

SEQ ID NO: 375987 - DNA, 6836 bp, Homo sapiens
  misc_feature (4693)..(4693): n is a, c, g, or t
  misc_feature (4764)..(4764): n is a, c, g, or t
gtcttcccccatctccataaattattctacctagctgctcagacaaaaattctgggccacatctgatttctttctttttctcaccacccctcatatcaaaactactagcagattccatcttctctacctccacaatatatactgaaattgtctatgtttccagctactgatagcctagactaagctagcctagactagaataaattataataactcttctaactggtctccatgcctccagttttgacctgttggctgctcaaactatgcaactgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375988 - DNA, 6596 bp, Homo sapiens
  misc_feature (13)..(13): n is a, c, g, or t
  misc_feature (16)..(16): n is a, c, g, or t
  misc_feature (22)..(22): n is a, c, g, or t
  misc_feature (24)..(24): n is a, c, g, or t
  misc_feature (31)..(31): n is a, c, g, or t
  misc_feature (4453)..(4453): n is a, c, g, or t
  misc_feature (4524)..(4524): n is a, c, g, or t
ggaactacttctnttncttctncngcttctnctgttgcagtgtgcttccgcggaagcacactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375989 - DNA, 6590 bp, Homo sapiens
  misc_feature (4447)..(4447): n is a, c, g, or t
  misc_feature (4518)..(4518): n is a, c, g, or t
agagcactggcccgagagctgagagcctgttgcagtgtgcttcccggaagcacactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375990 - DNA, 4154 bp, Homo sapiens
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgacaccactgagactggaacagacaatttctttgaccttcgtacaacttctttccacccttcttctcttgtctgaccccttttagggctagtgagattcagctttatgtttggagagcttaatggctatgacactgtcttgtagctggttgacaaggaacttaggagtcacttcacctgcaagtcgtgtctgagttttggatagtagcagtacttgtcttttcttcttgggaatgaaggtgcatgaggtatttaaa

SEQ ID NO: 375991 - DNA, 3662 bp, Homo sapiens
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttaaaataaagggccaggcgcggtggctcacgcctataatcccagcactttgggaggccgaggtg

SEQ ID NO: 375992 - DNA, 3054 bp, Homo sapiens
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagagaagcgacactccaagaccaagagaagtttaggactttctgccgtgccagtgggagaggtcacagtgacatctgggcctcctcccagcataccatacgctggagcagcagcacctcccctgccacttcctgggccccacacagatgggcatagtgaaaaaaaaaagaaaacagaagagaaggacaaagagagagagagag

SEQ ID NO: 375993 - DNA, 332 bp, Homo sapiens
aatgttatttccatttagcttaaaatcattgactatttgtagattccccgactgtctaatcattagtctcaaaaattattgcttggtgaaagctttttttaaaaaaagcttcaggaaacaaaagtgcatttggtggtatatgaagataacctaaaacaggatatctgtttcatttatgggcctttgtcttattctttggtctgagatgatttttttctgagttgactttttaggtgccacgtgtgccaacgcatacacttgccatggttgtacctccccaggaacctgacagaacttcacaggagaactctcctgcccttttaggagtgcaa

SEQ ID NO: 375994 - DNA, 660 bp, Homo sapiens
ggctgtgttgatctagaggatcccgggaaactctgagtggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataagaacggtggaaaaaatgtcatcaatgtgtcgaaaccatggtcacagcccaaaaactccttaagctgataagcaagttcagcaaagtctgaggatacaaaatcaatgtgcaaaaatcacaagcattcttatacaccagcaatagacaatattcttcaattcctatacaccaataatagacaagagagccaaatcatgaatggactcccattcacaatggttacaaagagaataaaatacctaggaatacagctaatgatgggtgtgaagaacctcttcaaggagaactacaagccactgctcaaagaaataagagaggacacaacaaatggaaagtattccagctcatggtgggaagatcagtctcatgaaaatggcatactgccaagtaatatagattccgggtatccatcaata

SEQ ID NO: 375995 - DNA, 9248 bp, Homo sapiens
  misc_feature (7105)..(7105): n is a, c, g, or t
  misc_feature (7176)..(7176): n is a, c, g, or t
atcattttcttcagtctcggtgtgtatttgtaaccattaaccaacctctcttcattccctgcccttcctggcctctggtaaccactagtctactctccatcttcatgagatccacttttttagcatggcactctttcaaacatttttcatgtgcttaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375996 - DNA, 9003 bp, Homo sapiens
  misc_feature (6860)..(6860): n is a, c, g, or t
  misc_feature (6931)..(6931): n is a, c, g, or t
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375997 - DNA, 6534 bp, Homo sapiens
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaac

SEQ ID NO: 375998 - DNA, 9012 bp, Homo sapiens
  misc_feature (6869)..(6869): n is a, c, g, or t
  misc_feature (6940)..(6940): n is a, c, g, or t
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggaacctgacagaacttcacaggagaactctcctgcccttttaggagtgcaaaaagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 375999 - DNA, 8356 bp, Homo sapiens
  misc_feature (6213)..(6213): n is a, c, g, or t
  misc_feature (6284)..(6284): n is a, c, g, or t
tagcaatatgaatattgtttttcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 376000 - DNA, 9381 bp, Homo sapiens
  misc_feature (7344)..(7344): n is a, c, g, or t
  misc_feature (7415)..(7415): n is a, c, g, or t
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggtaagaaatttcaggacttggaactacggtttccctctcttcatgtagattctggccaagtcctccccacaatccgaaaactagtgcaagagagaaccatccttagtttaagttaacttacagaagtggaggccgggcatggtggcttacgcttgtaatcccagcactttgggaggccgaggtgggtggattatctgaggtcaggagtttgagaccagcttgggcaacatggtgaaaccccatctctactaaaaatacaaaagttagccaggtgtggtggcatgtgcctgtaatcccagctactcagcaggctgaggcaggagaatcgctagaacccaggaggtggaagctgcagtgagccaagatcacgctactgcactccagcctgggcaacagagcaagactctctct

SEQ ID NO: 376001 - DNA, 5171 bp, Homo sapiens
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactctttgggaggccgaggtgggaggatcacttgaggtcaggagtttgagaccagtctgaccaaagtggtgaaaccccgtctccactaaaaatataaaaattagccaggcatgctggcgtgggcctgtaatccctgctactcgggaggctgaggcaggagaatcacttgaacccgggaggtggaggttgcagtgagccgagattgtgccacagtactccagcctgggtgacacagcgagactctgtctc

SEQ ID NO: 376002 - DNA, 5820 bp, Homo sapiens
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtaggaatcctggaggaactcttcccaaagagttttgaataagttattaaatcatttatttcagttacaacaccatgttgtaactttagtaaactaagtggtatacagatgcccaaggtttgttctgtggtcatgtgaaaaaattgtcagtcatttttagcatagaaaacttgagaattattctttcaagccaaaaatgttttacagtagaacttggatcaagaaaagaggtactaggctgggtgcagtggctgacacctgtaatcccagcactttgggaggcctaggcaagaggatcgcttgagcccagcagttggagaccagcctgggcaacagcaagaccctgtctctattaaaaaaaaaaaa

SEQ ID NO: 376003 - DNA, 5724 bp, Homo sapiens
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctgcttagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaatgaaaaagaataagtcacattggttccatggccacaaaccattcagatcagccacttgctgacctggttcttaaggacacatgacattagtccaatctttcaaaatcttgtcttagggcttgtgaggaatcagaactactcc

SEQ ID NO: 376004 - DNA, 7844 bp, Homo sapiens
  misc_feature (5701)..(5701): n is a, c, g, or t
  misc_feature (5772)..(5772): n is a, c, g, or t
tttaagcttaatattctatttggaagtatttgcctttttattcttaaattggtaggcatatatgcaaaatcaagggattcctttgtaattctgttgttttactttcttttattcttaagaataataatttttcttttcatgctaccttgtctaagattgttgtacttcttatagggtcatgtaaaagttgttcaatatttggtaaaggaagtaaatcagttcccttctgatatagaatgcatgagatacatagcaacaattacagataaggtaagtttaatatgctactgaagcacatttttgttctttgtggaatgatatgccaaagtgtgcagttaggaacttgttctttttatattctgaaaggttggtcacctgatctctttatgcgtttgtttctccatttgcaaaatagaggggtataatacttttgataaactattttgagatttctactgtggaccatagtcacagtgactacactaaggtactaaaccattagcctaatgagaaggcttcctaaggacatgcaggtttttagggaaatggtgtcttatttttgtgaaagattggactcaaaggataacttaatttggtttagtgacttttcagtttgaactttaacctctggactttaatgtgctcatcagcttaagttttatttggcctctttcattatatatttacataattctatttcctgctgtaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 376005 - DNA, 7209 bp, Homo sapiens
  misc_feature (5066)..(5066): n is a, c, g, or t
  misc_feature (5137)..(5137): n is a, c, g, or t
cgacctagaggacccccgtcctcatcatacctacctccttcatcatacctacccatagcaacaattacagataggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttgggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaaggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatnaaggcaaagaaggatgcacagagaaagagtagtaactagggacagaactatattagcagcacctttctacncttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaaaaa

SEQ ID NO: 376006 - DNA, 4694 bp, Homo sapiens
  misc_feature (4685)..(4685): n is a, c, g, or t
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacactggatggctgtgccctagttctagancgcgggcgg

SEQ ID NO: 376007 - DNA, 2967 bp, Homo sapiens
ttaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtgccacgtgtgccaacgcatacacttgccatggttgtacctccccaggaacctgacagaacttcacaggagaactctcctgcccttttaggagtgcaaaaaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatactgagagcaatcatgacacagcattaacactagcttgtgcaggtggtcatgaagaacttgtatctgtgctcattgcacgggatgccaaaattgaacacagagacaaaaaaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagggtcatgtaaaagttgttcaatatttggtaaaggaagtaaatcagttcccttctgatatagaatgcatgagatacatagcaacaattacagataaggaactgttgaaaaaatgtcatcaatgtgtcgaaaccattgtgaaggctaaagaccagcaagctgcagaagcaaataagaatgcgagtattcttttaaaggaacttgatctggaaaagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatgtgggagcaagaagttcccatagacctcctagtgctcccaagagtgtcg

SEQ ID NO: 376008 - DNA, 454 bp, Homo sapiens
aactaaagatagaaccaccgttcaactcagcaatcctactactgggtttctatctaaaggaaaagaaatcagtatatcaaaaagatacctgcatgcgtatgtttatcgcagcaatattcatgatagcaaatcatgatagcaaatcagcctgtggaatcaacctgagtgtccatcgatggatgactagataaaggaaatgtggcatatatacacaatggaatagtattcagctataaaaaagaatgaattcaggtcttttgcagcaaaatgggtgggattggagaacactacataaaacaactcagacacagaaagacaaatacctcatgttttcacttatatgtgggagttaaacaatgggtccatatggaagcagggtggggagtgatggaacagtgaggtcggggagtgagaagggtggaataataataataataaagactggatcagaatt

SEQ ID NO: 376009 - DNA, 2062 bp, Homo sapiens
ggtcgcggagccgtccgcctacgggggccgggacgtcgcctgcgcgtctctcgttttcggacggctgcagcatcgcggtggggatcgaaagcgggggcttctgggacgcagctctggagacgcggcctcggaccagccatttcggtgtagaagtggcagcacggcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaaattgtaaacatcacttatattactttattgcagcttcatcaccagtacattatatgttgtaatatttatttacctgatcattttgatcattttctgctttattttgctaataaactgtgatgttacttctagtgctaaacatggcatatttccacctatgattcgtgtttacctggtattaggagctcagaatggaatgcataaagcttcactggaagtgtatacaactgtggtgtagaatctgttattattatcattattattttatttagacttgactatctcttatgtttattaaagaacatgttttcctaaaaaattgct

SEQ ID NO: 376010 - DNA, 884 bp, Homo sapiens
ggtcgcggagccgtccgcctacgggggccgggacgtcgcctgcgcgtctctcgttttcggacggctgcagcatcgcggtggggatcgaaagcgggggcttctgggacgcagctctggagacgcggcctcggaccagccatttcggtgtagaagtggcagcacggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcggacatgtggtctcaatctcccaacctcaagtgatcctcctgcctcagcctcccaaagtgctgggattacactgtaagtcgctgtgcctgcccaataatcca

SEQ ID NO: 376011 - DNA, 1910 bp, Homo sapiens
  misc_feature (1014)..(1014): n is a, c, g, or t
  misc_feature (1016)..(1017): n is a, c, g, or t
  misc_feature (1054)..(1055): n is a, c, g, or t
  misc_feature (1059)..(1059): n is a, c, g, or t
  misc_feature (1063)..(1063): n is a, c, g, or t
  misc_feature (1085)..(1085): n is a, c, g, or t
  misc_feature (1105)..(1105): n is a, c, g, or t
  misc_feature (1129)..(1129): n is a, c, g, or t
  misc_feature (1141)..(1141): n is a, c, g, or t
  misc_feature (1143)..(1143): n is a, c, g, or t
  misc_feature (1149)..(1149): n is a, c, g, or t
  misc_feature (1156)..(1156): n is a, c, g, or t
  misc_feature (1160)..(1161): n is a, c, g, or t
  misc_feature (1180)..(1181): n is a, c, g, or t
  misc_feature (1192)..(1192): n is a, c, g, or t
  misc_feature (1195)..(1195): n is a, c, g, or t
  misc_feature (1208)..(1208): n is a, c, g, or t
  misc_feature (1219)..(1219): n is a, c, g, or t
  misc_feature (1241)..(1242): n is a, c, g, or t
  misc_feature (1244)..(1244): n is a, c, g, or t
  misc_feature (1259)..(1259): n is a, c, g, or t
  misc_feature (1266)..(1266): n is a, c, g, or t
  misc_feature (1279)..(1279): n is a, c, g, or t
aggcttatcaaagtcaagcactgtgtcacctggtaatgcaaacccttccagcatctctgcctttaggttttaggggggaatcgtcaaaacagacatgcagcccactacaaagtacttgaaagcaatagggcaccattcaagcacacgcctgcatttactgggctacgtttatttagggcattcaggtggctgtaattattgtgcataaatagttttctaaaaagcataaaactaaaaacttgatccatggaaacacagtgtggtttaggatggagatcggatttcactcacctcaaaataactcctggtgtttgcctccaagacccattaatttatgttatctcttgctctgtagcagtttggatttgtcacacttagcaaagtaatttggtttcccacaggttttgttctgttttatagaagcaagagaacggttttgtgtttcagagcatgaatacattccttcagaaatttagccagcatttcagaaggatatgaatttttatttttagctatttacacctgcctgaaaggttgatgctgctaaacattgatattacttgaaaagttgtgcccaaggcatattgcttctttcctagctaggaattgaaatgtttatgaagcttgctgaaaatttaccaggttaccaaaataagagtttatatctcttatgtagtgactaacagaaatagatttatgtattcaaccaaccgtccaatatttattaagccactaatatatgcattgaattatgctggatttggggtgacatcagattatacaacatacacttctcctgttccagttcccttttaacatgttattactgggcacttacagaatgacaaaatcacattaataagactcaggcctgacttcagattgtaaacagtctagctggtgaaacaaactcataaacaaatgcccagacattttactacaatataataagttccgtgaaagagataaacacaggatatattttagaatctcagaagcaggtcttggccgggngnngtggctcacgcctgtaatcccagcactttgggaggcnnaggngggnggatcacgaggtcaggagatcnagaccatcctggctaacacngtgaaaccccatctctactaaaantacaaaaaattngncgggcntggtggngggnncctgtagtcccagctactnnggaggctgagncangagaatggcgtgnacccggaggcngagcttgcagtgagccaagatnncnccactgcactccagnctgggcnacagagtgagacnccgtctcaaaaaaaaaaaaaaagaaagaagcaggtcttaacagaacctgaaagcatcaggaaaggcttctggcaggagataaagcctgagcttgaagttttgagaagaaagacttcaatagatgtcagaaagtagaaaagctgtcccagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaaattgtaaacatcacttatattactttattgcagcttcatcaccagtacattatatgttgtaatatttatttacctgatcattttgatcattttctgctttattttgctaataaactgtgatgttacttctagtgctaaacatggcatatttccacctatgattcgtgtttacctggtattaggagctcagaatggaatgcataaagcttcactggaagtgtatacaactgtggtgtagaatctgttattattatcattattattttatttagacttgactatctcttatgtttattaaagaacatgttttcctaaaaaattgct

SEQ ID NO: 376012 - DNA, 1081 bp, Homo sapiens
ggtcgcggagccgtccgcctacgggggccgggacgtcgcctgcgcgtctctcgttttcggacggctgcagcatcgcggtggggatcgaaagcgggggcttctgggacgcagctctggagacgcggcctcggaccagccatttcggtgtagaagtggcagcacggcagactggtcaaacaaatggattttacagaggcttacgcggacacgtgctctacagttggacttgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgctggctggctggctggctggctggctggctgcatggcatggcatggcatggcatggcatggcatggcatgcatggcatggcatggcatggcatggcatggcatggcatgcctggcctggcctggcctggcctggcctggcctggcctgcctggcctggcctggcctggcctggcctggcctggcctcctggcctggcctggcctggcctggcctggcctggcctgcctggcctggcctggcctggcctggcctggcctggcct

SEQ ID NO: 376013 - DNA, 2269 bp, Homo sapiens
tccgtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaaattgtaaacatcacttatattactttattgcagcttcatcaccagtacattatatgttgtaatatttatttacctgatcattttgatcattttctgctttattttgctaataaactgtgatgttacttctagtgctaaacatggcatatttccacctatgattcgtgtttacctggtattaggagctcagaatggaatgcataaagcttcactggaagtgtatacaactgtggtgtagaatctgttattattatcattattattttatttagacttgactatctcttatgtttattaaagaacatgttttcctaaaaaattgct

SEQ ID NO: 376014 - DNA, 1958 bp, Homo sapiens
gggtgaagccactgggaattctcaccttatgcagtggggaggagcctggcctcttcagctcatattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaaattgtaaacatcacttatattactttattgcagcttcatcaccagtacattatatgttgtaatatttatttacctgatcattttgatcattttctgctttattttgctaataaactgtgatgttacttctagtgctaaacatggcatatttccacctatgattcgtgtttacctggtattaggagctcagaatggaatgcataaagcttcactggaagtgtatacaactgtggtgtagaatctgttattattatcattattattttatttagacttgactatctcttatgtttattaaagaacatgttttcctaaaaaattgct

SEQ ID NO: 376015 - DNA, 2090 bp, Homo sapiens
agtgctggtttcttttacgggagaatgatagtgaaaaccaagatgtaaggccaggcatggtggctcacgcctgtaatctcagcactttgggaggccaagtcgggcagatcacctgaggccaggagtttgagaccagcctggccaacatggcaaaaacatgtctctactaaaaaaaaaatacaaaaaattacccagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaaattgtaaacatcacttatattactttattgcagcttcatcaccagtacattatatgttgtaatatttatttacctgatcattttgatcattttctgctttattttgctaataaactgtgatgttacttctagtgctaaacatggcatatttccacctatgattcgtgtttacctggtattaggagctcagaatggaatgcataaagcttcactggaagtgtatacaactgtggtgtagaatctgttattattatcattattattttatttagacttgactatctcttatgtttattaaagaacatgttttcctaaaaaattgct

SEQ ID NO: 376016 - DNA, 2358 bp, Homo sapiens
ggtcgcggagccgtccgcctacgggggccgggacgtcgcctgcgcgtctctcgttttcggacggctgcagcatcgcggtggggatcgaaagcgggggcttctgggacgcagctctggagacgcggcctcggaccagccatttcggtgtagaagtggcagcacggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagaggaagcatttattgaggctcagctatacgcaatctccattctagccgctttcctcaagaaatcgtctacgtggaggagtaaaaaagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaaattgtaaacatcacttatattactttattgcagcttcatcaccagtacattatatgttgtaatatttatttacctgatcattttgatcattttctgctttattttgctaataaactgtgatgttacttctagtgctaaacatggcatatttccacctatgattcgtgtttacctggtattaggagctcagaatggaatgcataaagcttcactggaagtgtatacaactgtggtgtagaatctgttattattatcattattattttatttagacttgactatctcttatgtttattaaagaacatgttttcctaaaaaattgct

SEQ ID NO: 376017 - DNA, 1901 bp, Homo sapiens
tccgtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaaattgtaaacatcacttatattactttattgcagcttcatcaccagtacattatatgttgtaatatttatttacctgatcattttgatcattttctgctttattttgctaataaactgtgatgttacttctagtgctaaacatggcatatttccacctatgattcgtgtttacctggtattaggagctcagaatggaatgcataaagcttcactggaagtgtatacaactgtggtgtagaatctgttattattatcattattattttatttagacttgactatctcttatgtttattaaagaacatgttttcctaaaaaattgct

SEQ ID NO: 376018 - DNA, 2271 bp, Homo sapiens
ggtcgcggagccgtccgcctacgggggccgggacgtcgcctgcgcgtctctcgttttcggacggctgcagcatcgcggtggggatcgaaagcgggggcttctgggacgcagctctggagacgcggcctcggaccagccatttcggtgtagaagtggcagcacggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaaattgtaaacatcacttatattactttattgcagcttcatcaccagtacattatatgttgtaatatttatttacctgatcattttgatcattttctgctttattttgctaataaactgtgatgttacttctagtgctaaacatggcatatttccacctatgattcgtgtttacctggtattaggagctcagaatggaatgcataaagcttcactggaagtgtatacaactgtggtgtagaatctgttattattatcattattattttatttagacttgactatctcttatgtttattaaagaacatgttttcctaaaaaattgct

SEQ ID NO: 376019 - DNA, 430 bp, Homo sapiens
ggtcgcggagccgtccgcctacgggggccgggacgtcgcctgcgcgtctctcgttttcggacggctgcagcatcgcggtggggatcgaaagcgggggcttctgggacgcagctctggagacgcggcctcggaccagccatttcggtgtagaagtggcagcacggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcaggtaaagtaaattcaaggtatggaggctttgcctacaagctggattaataaaaca

SEQ ID NO: 376020 - DNA, 882 bp, Homo sapiens
aatttcagattttcagattagggatgctgaactggtgtaatgcccagtattccaaaatccaaaataatttgaaatctgaaacacttaatggtcccagcatgttggataagggatactcaacctgtattgatttttctccactataattcagttctataagttcttccctataaaaaatgaatgaattagaaatttgataataaaacatattttattaattttaaactctatcttgcagtctgatcattcagaaaggtcaacctagaaaaaagacatggctaagtaaactattttaagccataactaagtattttggaaagccttcattaacacataaagaattttggccaagtactgtggcttatgcctgtaatcctagcactttggaaagccgaggccgacggatcacttgagctcaggagtttgagaccaacctgcgtaacatggtgaaaccccatatctacaaaaagtacaaaaattagctgggtgcggtggcgcatgcctgtagtcccatctactcggaagactgaggcagcagaaccgcttgagcctaggaggtggaggttgcagtaagatgagatcatgctgctgtactctagcctgggcaatgagagtgaaactcttatctcaaaaaaaaaaaaaaaaaagagctatactcatagtactttgggagaccaagcagggaggattacttgagaccaggagtttgagactaccatggacaacatagcaagaccccatctttacaaaaaatttaaaaattagccagacacctatagtaccagctacttaggagtctaaagtgggagaattgcttgagcctgggaggttgaagcagcagtgagctttgatcatgccactgcattccagcctgggtaacaa

SEQ ID NO: 376021 - DNA, 5547 bp, Homo sapiens
gcatgatttatgcctctcttgggctttagattttattcctttacttttctataactctgtcatgaccagtttaaaggccccaatgtcatgtcctcgcattaacaaccaaggctacaatgcaagccctgccatgtgcgcttctttacaaaaggtcaaagtaaaaaggaaatctataccaaagagcctctagatactatttccagcttcggggaagtccatagtaggtacttccacgggtagagaacattatcttagactgggataagggttggtattcgcagtccccttcctacgttctgcccattgtaaagaccagggtcagcgttgagcctcgcccttcttgctagaactacaactcccaggatgccccgcggcacgggagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagctttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattttttaaaatacatgaacttggcaagggtgtgatttttctttatcaagagaacaaaatgccagaatgttaaaacagttaactcaaaatctagtcatctgtgtaggagctaaagcaggtctccctccccaccccccaaaaaaggcgtacagccaactcttagttatttagggtaagagaaaaaagaaaactgttaaacaatgaaatcaaagataataaatatgatagatttccagtatgaggcacttgcaaaacagtcatttaaactgatggttactgtaagtcagttggaagctggcatgtatgtaaattacttggtgttacaccatatccgaagaagttcctatgtgcagtgcagaattgcataaacagtatttaatcactgctacaaatcttccaaccaagaaggaaaactgctattcttcataaatctaatttttagtatatgcttcctttcatcttatacttttatcaatatttataaaagtcatttctataataaaagcagtctttcttgctcaaagtattaaggtgaacaattgaatagagtactgtggtcgggagactgatttgagactgcagagctgatgctgggtagagggtctggacttgtattcatgttctgtctcagggcagcccctggagcaggagatggcagaggcatttacagctgcagaaaacagggaggaatggaatctgaggtagccctggcctcaaaattcaggcctggctgtatcatttacagagatttttctggagggaaaagtctcatttctgaggaaggcaaggtggctaatcattattaattttttttaaactttttgggccgggcgcagtggctcacgcctgtaatcccagcacttttgggaagccaaagtgggtggatcacttaaggtcaggagttcaagaccagcctggccaacatggtgaaaccctgtctctactaaaaatcaaaaaagtagccgggtgtggtggtgcacacctgtaatcccagctactcgggaggctgaggcaggagaattgcttgaacctgggagatggagattgcagtgagctgagatcgtaccactgcactgcagtctgggtgacaaagcaagactctgtctcaaaaaacaaacaaacaaacaaactttttgaaattgaattgcaatatgtctgctactttggcttgggctggacagtttatctaataagcaaggcagcttcttgtgtgctatggtaataagccttcttaacaggctaagcttccctcataagaactgtggtgtttctctttttttttttttgttttggtttgttttggttttttggtttggttttgttttgttttttaaatcagtatccaatgttttataggggccaaaggttaactttgcactattccctgtcagttaaaggccactgatatttttctaagttagcaaggctcacttgcttgctttcttgcctcccttgcctccatccctctcccttcctaccttctctatttacctatttctctccctccctctcttctcctctctttttttttcccccgcatatgcagctttttgattgtacttgattttatagagactgcacagttccagcaagattgggagtcaggcatggagcaggcatctcaggctaccagaaagaattggtcacctagactttcagtcaggcatcctcgtttgcattgtcctgtaagtcaattagttgataaatagttcccccttcatcccttaagttttgtttttgtttttgtttttaatataggtaagtgggactctacctaaaattttgcatcatacttatgggtaatatctttttcatatattatttatcaaagtatgaagttgagtattttgcttgtaccatttcaattctgcattatagtagttcattgtataactgaaagaaatgatttcttcataagtgacattaaatatgaacattcatccaattgaatttacaaaatctttccaaaattataagggagaaaaatcgggtttacttcaatctttaaaaatctggcacctcttagtaactttcagtatttctaaattgctctaaaattttataataaatagattagggttttgcaatagtcttaatttttaagccaaaggttttctgagaccttaggttttgtagtctaaccagcttatgtggttatttaaaagaatattctttgtgtttttaaattgctatttttaaaaaagctttttattacccattttataaaatgttatactcatatttgtctgaatttttccagtattcctacatgaaattgtatgtattaaaaactcaatattagtggcaaatattaatactattaaaatggattttggtgctatattcttgtagctaaagcctagtagaattctcaagaataggtgaaatacactttcaaagttgcctgtcatttaaaagaccaaataagcattttgtattaaataaattagcagatggttagagacttcaaggagagttagcttggtcatttaattgcgacttcatgttatttgattgaaataacccacatccttgctttgtataagatattcgctctggagaagttacatgtaaatagaattctataaattgttttccagttgaccgagtatctgttgtgtttttgtttaaaaagaggattccatgacataataaaaattattttaaaaaatgttttggtgctgggattacaggtgtttgccaccgcgcccagcccaaattattacattcgtaagacagacacctcttagaatctatatatatgaggttttactcccttttctacactcagtatgttttaattgatgcaaagcaattaattggcctaaaatgtttcaaatattatagtctatacattcagaaagtaaggtttaagaatgaattattggtgcttcttggtgggtgtatatagcagtttttagaagtttaaatttcacctctactcagaaagataagcttttgattcagtggtttcaaattttcagatcgatccatttaagaattgttttttcaaatgtatatacacgtataacataaaaatttttgtaatttcaaatgtctttttttcagttttttggatgaattattatatttggttttagttacatttaaaagcttgaaaattacctttctaacaatcatttgaatgtcattcattgtcacatgaaatcaggtatttacgtttttttctaatgctaaaatatccaacattgtaattgccctatttttccatttttataagtataaaagcaatgaattttaacactggtatttaaataatacaaaatattatccaaattcataacagcacagtgaagtttcttttgaagactatgtactggaagcatttagaacttaccaatatatactgggataaatcgtttcaataaagtttatcaaat

SEQ ID NO: 376022 - DNA, 4845 bp, Homo sapiens
gcatgatttatgcctctcttgggctttagattttattcctttacttttctataactctgtcatgaccagtttaaaggccccaatgtcatgtcctcgcattaacaaccaaggctacaatgcaagccctgccatgtgcgcttctttacaaaaggtcaaagtaaaaaggaaatctataccaaagagcctctagatactatttccagcttcggggaagtccatagtaggtacttccacgggtagagaacattatcttagactgggataagggttggtattcgcagtccccttcctacgttctgcccattgtaaagaccagggtcagcgttgagcctcgcccttcttgctagaactacaactcccaggatgccccgcggcacgggagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagctttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattttttaaaatacatgaacttggcaagggtgtgatttttctttatcaagagaacaaaatgccagaatgttaaaacagttaactcaaaatctagtcatctgtgtaggagctaaagcaggtctccagggagagagggtggtcgtctgtgcattccaggttactgcacttgtctgatgtgacgtagcaacacccaggtcttcttaaaacaaagtcatcagctttgccaggttacatactttatttaaaagtatagtgaggtcgaagttcattccagtgtttcattttaataatgtgggcattattaaatttttgtggaagctaatagtaaaaaataaaagctgttttcaccacctccctccccaccccccaaaaaaggcgtacagccaactcttagttatttagggtaagagaaaaaagaaaactgttaaacaatgaaatcaaagataataaatatgatagatttccagtatgaggcacttgcaaaacagtcatttaaactgatggttactgtaagtcagttggaagctggcatgtatgtaaattacttggtgttacaccatatccgaagaagttcctatgtgcagtgcagaattgcataaacagtatttaatcactgctacaaatcttccaaccaagaaggaaaactgctattcttcataaatctaatttttagtatatgcttcctttcatcttatacttttatcaatatttataaaagtcatttctataataaaagcagtctttcttgctcaaagtattaaggtgaacaattgaatagagtactgtggtcgggagactgatttgagactgcagagctgatgctgggtagagggtctggacttgtattcatgttctgtctcagggcagcccctggagcaggagatggcagaggcatttacagctgcagaaaacagggaggaatggaatctgaggtagccctggcctcaaaattcaggcctggctgtatcatttacagagatttttctggagggaaaagtctcatttctgaggaaggcaaggtggctaatcattattaattttttttaaactttttgggccgggcgcagtggctcacgcctgtaatcccagcacttttgggaagccaaagtgggtggatcacttaaggtcaggagttcaagaccagcctggccaacatggtgaaaccctgtctctactaaaaatcaaaaaagtagccgggtgtggtggtgcacacctgtaatcccagctactcgggaggctgaggcaggagaattgcttgaacctgggagatggagattgcagtgagctgagatcgtaccactgcactgcagtctgggtgacaaagcaagactctgtctcaaaaaacaaacaaacaaacaaactttttgaaattgaattgcaatatgtctgctactttggcttgggctggacagtttatctaataagcaaggcagcttcttgtgtgctatggtaataagccttcttaacaggctaagcttccctcataagaactgtggtgtttctctttttttttttttgttttggtttgttttggttttttggtttggttttgttttgttttttaaatcagtatccaatgttttataggggccaaaggttaactttgcactattccctgtcagttaaaggccactgatatttttctaagttagcaaggctcacttgcttgctttcttgcctcccttgcctccatccctctcccttcctaccttctctatttacctatttctctccctccctctcttctcctctctttttttttcccccgcatatgcagctttttgattgtacttgattttatagagactgcacagttccagcaagattgggagtcaggcatggagcaggcatctcaggctaccagaaagaattggtcacctagactttcagtcaggcatcctcgtttgcattgtcctgtaagtcaattagttgataaatagttcccccttcatcccttaagttttgtttttgtttttgtttttaatataggtaagtgggactctacctaaaattttgcatcatacttatgggtaatatctttttcatatattatttatcaaagtatgaagttgagtattttgcttgtaccatttcaattctgcattatagtagttcattgtataactgaaagaaatgatttcttcataagtgacattaaatatgaacattcatccaattgaatttacaaaatctttccaaaattataagggagaaaaatcgggtttacttcaatctttaaaaatctggcacctcttagtaactttcagtatttctaaattgctctaaaattttataataaatagattagggttttgcaatagtcttaatttttaagccaaaggttttctgagaccttaggttttgtagtctaaccagcttatgtggttatttaaaagaatattctttgtgtttttaaattgctatttttaaaaaagctttttattacccattttataaaatgttatactcatatttgtctgaatttttccagtattcctacatgaaattgtatgtattaaaaactcaatattagtggcaaatattaatactattaaaatggattttggtgctatattcttgtagctaaagcctagtagaattctcaagaataggtgaaatacactttcaaagttgcctgtcatttaaaagaccaaataagcattttgtattaaataaattagcagatggttagagacttc

SEQ ID NO: 376023 - DNA, 3880 bp, Homo sapiens
ccgagtctggctcccatcagagaagtagtatggtgtagaccaagaacatatttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattttttaaaatacatgaacttggcaagggtgtgatttttctttatcaagagaacaaaatgccagaatgttaaaacagttaactcaaaatctagtcatctgtgtaggagctaaagcaggtctccagggagagagggtggtcgtctgtgcattccaggttactgcacttgtctgatgtgacgtagcaacacccaggtcttcttaaaacaaagtcatcagctttgccaggttacatactttatttaaaagtatagtgaggtcgaagttcattccagtgtttcattttaataatgtgggcattattaaatttttgtggaagctaatagtaaaaaataaaagctgttttcaccacctccctccccaccccccaaaaaaggcgtacagccaactcttagttatttagggtaagagaaaaaagaaaactgttaaacaatgaaatcaaagataataaatatgatagatttccagtatgaggcacttgcaaaacagtcatttaaactgatggttactgtaagtcagttggaagctggcatgtatgtaaattacttggtgttacaccatatccgaagaagttcctatgtgcagtgcagaattgcataaacagtatttaatcactgctacaaatcttccaaccaagaaggaaaactgctattcttcataaatctaatttttagtatatgcttcctttcatcttatacttttatcaatatttataaaagtcatttctataataaaagcagtctttcttgctcaaagtattaaggtgaacaattgaatagagtactgtggtcgggagactgatttgagactgcagagctgatgctgggtagagggtctggacttgtattcatgttctgtctcagggcagcccctggagcaggagatggcagaggcatttacagctgcagaaaacagggaggaatggaatctgaggtagccctggcctcaaaattcaggcctggctgtatcatttacagagatttttctggagggaaaagtctcatttctgaggaaggcaaggtggctaatcattattaattttttttaaactttttgggccgggcgcagtggctcacgcctgtaatcccagcacttttgggaagccaaagtgggtggatcacttaaggtcaggagttcaagaccagcctggccaacatggtgaaaccctgtctctactaaaaatcaaaaaagtagccgggtgtggtggtgcacacctgtaatcccagctactcgggaggctgaggcaggagaattgcttgaacctgggagatggagattgcagtgagctgagatcgtaccactgcactgcagtctgggtgacaaagcaagactctgtctcaaaaaacaaacaaacaaacaaactttttgaaattgaattgcaatatgtctgctactttggcttgggctggacagtttatctaataagcaaggcagcttcttgtgtgctatggtaataagccttcttaacaggctaagcttccctcataagaactgtggtgtttctctttttttttttttgttttggtttgttttggttttttggtttggttttgttttgttttttaaatcagtatccaatgttttataggggccaaaggttaactttgcactattccctgtcagttaaaggccactgatatttttctaagttagcaaggctcacttgcttgctttcttgcctcccttgcctccatccctctcccttcctaccttctctatttacctatttctctccctccctctcttctcctctctttttttttcccccgcatatgcagctttttgattgtacttgattttatagagactgcacagttccagcaagattgggagtcaggcatggagcaggcatctcaggctaccagaaagaattggtcacctagactttcagtcaggcatcctcgtttgcattgtcctgtaagtcaattagttgataaatagttcccccttcatcccttaagttttgtttttgtttttgtttttaatataggtaagtgggactctacctaaaattttgcatcatacttatgggtaatatctttttcatatattatttatcaaagtatgaagttgagtattttgcttgtaccatttcaattctgcattatagtagttcattgtataactgaaagaaatgatttcttcataagtgacattaaatatgaacattcatccaattgaatttacaaaatctttccaaaattataagggagaaaaatcgggtttacttcaatctttaaaaatctggcacctcttagtaactttcagtatttctaaattgctctaaaattttataataaatagattagggttttgcaatagtcttaatttttaagccaaaggttttctgagaccttaggttttgtagtctaaccagcttatgtggttatttaaaagaatattctttgtgtttttaaattgctatttttaaaaaagctttttattacccattttataaaatgttatactcatatttgtctgaatttttccagtattcctacatgaaattgtatgtattaaaaactcaatattagtggcaaatattaatactattaaaatggattttggtgctatattcttgtagctaaagcctagtagaattctcaagaataggtgaaatacactttcaaagttgcctgtcatttaaaagaccaaataagcattttgtattaaataaattagcagatggttagagacttcaaggagagttagcttggtcatttaattgcgacttcatgttatttgattgaaataacccacatccttgctttgtataagatattcgctctggagaagttacatgtaaatagaattctataaattgttttccagttg

SEQ ID NO: 376024 - DNA, 2767 bp, Homo sapiens
gcatgatttatgcctctcttgggctttagattttattcctttacttttctataactctgtcatgaccagtttaaaggccccaatgtcatgtcctcgcattaacaaccaaggctacaatgcaagccctgccatgtgcgcttctttacaaaaggtcaaagtaaaaaggaaatctataccaaagagcctctagatactatttccagcttcggggaagtccatagtaggtacttccacgggtagagaacattatcttagactgggataagggttggtattcgcagtccccttcctacgttctgcccattgtaaagaccagggtcagcgttgagcctcgcccttcttgctagaactacaactcccaggatgccccgcggcacgggagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagctttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattctttgcaagtttagtactgcccaaatttactcattctacagtgttactgcactttgaacgtattgacccatgtcacccaagagaagcaaacatatggatgcactagagacaactcgggttgctgctctcagttaagggctatgagttcttggggtctaagtatctgtaaaattatcctctccatcagctctcactgatcattaatgtttctggatatttcttaccctaagatttgcttaccaacaaatcaaagaaacgcttcactaattatttttaaattgagaaaatagtattcagaggcaaagatttttatattcttttttgagaccatctagcctgggcaatgagagtgaaactcttatctcaaaaaaaaaaaaaaaaaagagctatactcatagtactttgggagaccaagcagggaggattacttgagaccaggagtttgagactaccatggacaacatagcaagaccccatctttacaaaaaatttaaaaattagccagacacctatagtaccagctacttaggagtctaaagtgggagaattgcttgagcctgggaggttgaagcagcagtgagctttgatcatgccactgcattccagcctgggtaacaa

SEQ ID NO: 376025 - DNA, 2466 bp, Homo sapiens
gcttcgcttgtttcttttgtgtgtgtgttttgttttgttttgttttgttttgagacagtctcgctgtgtcgcccaagcaggagaattgcttgaacctgggagatggagattgcagtgagctgagatcgtaccactgcactgcagtctgggtgacaaagcaagactctgtctcaaaaaacaaacaaacaaacaaactttttgaaattgaattgcaatatgtctgctactttggcttgggctggacagtttatctaataagcaaggcagcttcttgtgtgctatggtaataagccttcttaacaggctaagcttccctcataagaactgtggtgtttctctttttttttttttgttttggtttgttttggttttttggtttggttttgttttgttttttaaatcagtatccaatgttttataggggccaaaggttaactttgcactattccctgtcagttaaaggccactgatatttttctaagttagcaaggctcacttgcttgctttcttgcctcccttgcctccatccctctcccttcctaccttctctatttacctatttctctccctccctctcttctcctctctttttttttcccccgcatatgcagctttttgattgtacttgattttatagagactgcacagttccagcaagattgggagtcaggcatggagcaggcatctcaggctaccagaaagaattggtcacctagactttcagtcaggcatcctcgtttgcattgtcctgtaagtcaattagttgataaatagttcccccttcatcccttaagttttgtttttgtttttgtttttaatataggtaagtgggactctacctaaaattttgcatcatacttatgggtaatatctttttcatatattatttatcaaagtatgaagttgagtattttgcttgtaccatttcaattctgcattatagtagttcattgtataactgaaagaaatgatttcttcataagtgacattaaatatgaacattcatccaattgaatttacaaaatctttccaaaattataagggagaaaaatcgggtttacttcaatctttaaaaatctggcacctcttagtaactttcagtatttctaaattgctctaaaattttataataaatagattagggttttgcaatagtcttaatttttaagccaaaggttttctgagaccttaggttttgtagtctaaccagcttatgtggttatttaaaagaatattctttgtgtttttaaattgctatttttaaaaaagctttttattacccattttataaaatgttatactcatatttgtctgaatttttccagtattcctacatgaaattgtatgtattaaaaactcaatattagtggcaaatattaatactattaaaatggattttggtgctatattcttgtagctaaagcctagtagaattctcaagaataggtgaaatacactttcaaagttgcctgtcatttaaaagaccaaataagcattttgtattaaataaattagcagatggttagagacttcaaggagagttagcttggtcatttaattgcgacttcatgttatttgattgaaataacccacatccttgctttgtataagatattcgctctggagaagttacatgtaaatagaattctataaattgttttccagttgaccgagtatctgttgtgtttttgtttaaaaagaggattccatgacataataaaaattattttaaaaaatgttttggtgctgggattacaggtgtttgccaccgcgcccagcccaaattattacattcgtaagacagacacctcttagaatctatatatatgaggttttactcccttttctacactcagtatgttttaattgatgcaaagcaattaattggcctaaaatgtttcaaatattatagtctatacattcagaaagtaaggtttaagaatgaattattggtgcttcttggtgggtgtatatagcagtttttagaagtttaaatttcacctctactcagaaagataagcttttgattcagtggtttcaaattttcagatcgatccatttaagaattgttttttcaaatgtatatacacgtataacataaaaatttttgtaatttcaaatgtctttttttcagttttttggatgaattattatatttggttttagttacatttaaaagcttgaaaattacctttctaacaatcatttgaatgtcattcattgtcacatgaaatcaggtatttacgtttttttctaatgctaaaatatccaacattgtaattgccctatttttccatttttataagtataaaagcaatgaattttaacactggtatttaaataatacaaaatattatccaaattcataacagcacagtgaagtttcttttgaagactatgtactggaagcatttagaacttaccaatatatactgggataaatcgtttcaataaagtttatcaaat

SEQ ID NO: 376026 - DNA, 2390 bp, Homo sapiens
tgagacagagtctcgctctgtcgcccaggctggagtgcatgagctgagatcgtaccactgcactgcagtctgggtgacaaagcaagactctgtctcaaaaaacaaacaaacaaacaaactttttgaaattgaattgcaatatgtctgctactttggcttgggctggacagtttatctaataagcaaggcagcttcttgtgtgctatggtaataagccttcttaacaggctaagcttccctcataagaactgtggtgtttctctttttttttttttgttttggtttgttttggttttttggtttggttttgttttgttttttaaatcagtatccaatgttttataggggccaaaggttaactttgcactattccctgtcagttaaaggccactgatatttttctaagttagcaaggctcacttgcttgctttcttgcctcccttgcctccatccctctcccttcctaccttctctatttacctatttctctccctccctctcttctcctctctttttttttcccccgcatatgcagctttttgattgtacttgattttatagagactgcacagttccagcaagattgggagtcaggcatggagcaggcatctcaggctaccagaaagaattggtcacctagactttcagtcaggcatcctcgtttgcattgtcctgtaagtcaattagttgataaatagttcccccttcatcccttaagttttgtttttgtttttgtttttaatataggtaagtgggactctacctaaaattttgcatcatacttatgggtaatatctttttcatatattatttatcaaagtatgaagttgagtattttgcttgtaccatttcaattctgcattatagtagttcattgtataactgaaagaaatgatttcttcataagtgacattaaatatgaacattcatccaattgaatttacaaaatctttccaaaattataagggagaaaaatcgggtttacttcaatctttaaaaatctggcacctcttagtaactttcagtatttctaaattgctctaaaattttataataaatagattagggttttgcaatagtcttaatttttaagccaaaggttttctgagaccttaggttttgtagtctaaccagcttatgtggttatttaaaagaatattctttgtgtttttaaattgctatttttaaaaaagctttttattacccattttataaaatgttatactcatatttgtctgaatttttccagtattcctacatgaaattgtatgtattaaaaactcaatattagtggcaaatattaatactattaaaatggattttggtgctatattcttgtagctaaagcctagtagaattctcaagaataggtgaaatacactttcaaagttgcctgtcatttaaaagaccaaataagcattttgtattaaataaattagcagatggttagagacttcaaggagagttagcttggtcatttaattgcgacttcatgttatttgattgaaataacccacatccttgctttgtataagatattcgctctggagaagttacatgtaaatagaattctataaattgttttccagttgaccgagtatctgttgtgtttttgtttaaaaagaggattccatgacataataaaaattattttaaaaaatgttttggtgctgggattacaggtgtttgccaccgcgcccagcccaaattattacattcgtaagacagacacctcttagaatctatatatatgaggttttactcccttttctacactcagtatgttttaattgatgcaaagcaattaattggcctaaaatgtttcaaatattatagtctatacattcagaaagtaaggtttaagaatgaattattggtgcttcttggtgggtgtatatagcagtttttagaagtttaaatttcacctctactcagaaagataagcttttgattcagtggtttcaaattttcagatcgatccatttaagaattgttttttcaaatgtatatacacgtataacataaaaatttttgtaatttcaaatgtctttttttcagttttttggatgaattattatatttggttttagttacatttaaaagcttgaaaattacctttctaacaatcatttgaatgtcattcattgtcacatgaaatcaggtatttacgtttttttctaatgctaaaatatccaacattgtaattgccctatttttccatttttataagtataaaagcaatgaattttaacactggtatttaaataatacaaaatattatccaaattcataacagcacagtgaagtttcttttgaagactatgtactggaagcatttagaacttaccaatatatactgggataaatcgtttcaataaagtttatcaaat

SEQ ID NO: 376027 - DNA, 1637 bp, Homo sapiens
gcatgatttatgcctctcttgggctttagattttattcctttacttttctataactctgtcatgaccagtttaaaggccccaatgtcatgtcctcgcattaacaaccaaggctacaatgcaagccctgccatgtgcgcttctttacaaaaggtcaaagtaaaaaggaaatctataccaaagagcctctagatactatttccagcttcggggaagtccatagtaggtacttccacgggtagagaacattatcttagactgggataagggttggtattcgcagtccccttcctacgttctgcccattgtaaagaccagggtcagcgttgagcctcgcccttcttgctagaactacaactcccaggatgccccgcggcacgggagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagctttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgatgggagaagactgcgctaaaatacaacaacaacaacaacaacaaactaagtacacttggtaccttggaaaatgctgaatgctatcatgatgctggtatatttgttatgagccacagaaatacctttatataactatactactgatgcgaga

SEQ ID NO: 376028 - DNA, 1174 bp, Homo sapiens
aatttcagattttcagattagggatgctgaactggtgtaatgcccagtattccaaaatccaaaataatttgaaatctgaaacacttaatggtcccagcatgttggataagggatactcaacctgtattgatttttctccactataattcagttctataagttcttccctataaaaaatgaatgaattagaaatttgataataaaacatattttattaattttaaactctatcttgcagtctgatcattcagaaaggtcaacctagaaaaaagacatggctaagtaaactattttaagccataactaagtattttggaaagccttcattaacacataaagaattttggccaagtactgtggcttatgcctgtaatcctagcactttggaaagccgaggccgacggatcacttgagtcctgacctcgtaatccacccgcctcggcctcccaaagtgctgggattacaggtgtttgccaccgcgcccagcccaaattattacattcgtaagacagacacctcttagaatctatatatatgaggttttactcccttttctacactcagtatgttttaattgatgcaaagcaattaattggcctaaaatgtttcaaatattatagtctatacattcagaaagtaaggtttaagaatgaattattggtgcttcttggtgggtgtatatagcagtttttagaagtttaaatttcacctctactcagaaagataagcttttgattcagtggtttcaaattttcagatcgatccatttaagaattgttttttcaaatgtatatacacgtataacataaaaatttttgtaatttcaaatgtctttttttcagttttttggatgaattattatatttggttttagttacatttaaaagcttgaaaattacctttctaacaatcatttgaatgtcattcattgtcacatgaaatcaggtatttacgtttttttctaatgctaaaatatccaacattgtaattgccctatttttccatttttataagtataaaagcaatgaattttaacactggtatttaaataatacaaaatattatccaaattcataacagcacagtgaagtttcttttgaagactatgtactggaagcatttagaacttaccaatatatactgggataaatcgtttcaataaagtttatcaaat

SEQ ID NO: 376029 - DNA, 1120 bp, Homo sapiens
aatttcagattttcagattagggatgctgaactggtgtaatgcccagtattccaaaatccaaaataatttgaaatctgaaacacttaatggtcccagcatgttggataagggatactcaacctgtattgatttttctccactataattcagttctataagttcttccctataaaaaatgaatgaattagaaatttgataataaaacatattttattaattttaaactctatcttgcagtctgatcattcagaaaggtcaacctagaccttcattaacacataaagaattttggccaagtactgtggcttatgcctgtaatcctagcactttggaaagccgaggccgacggatcacttgagtcctgacctcgtaatccacccgcctcggcctcccaaagtgctgggattacaggtgtttgccaccgcgcccagcccaaattattacattcgtaagacagacacctcttagaatctatatatatgaggttttactcccttttctacactcagtatgttttaattgatgcaaagcaattaattggcctaaaatgtttcaaatattatagtctatacattcagaaagtaaggtttaagaatgaattattggtgcttcttggtgggtgtatatagcagtttttagaagtttaaatttcacctctactcagaaagataagcttttgattcagtggtttcaaattttcagatcgatccatttaagaattgttttttcaaatgtatatacacgtataacataaaaatttttgtaatttcaaatgtctttttttcagttttttggatgaattattatatttggttttagttacatttaaaagcttgaaaattacctttctaacaatcatttgaatgtcattcattgtcacatgaaatcaggtatttacgtttttttctaatgctaaaatatccaacattgtaattgccctatttttccatttttataagtataaaagcaatgaattttaacactggtatttaaataatacaaaatattatccaaattcataacagcacagtgaagtttcttttgaagactatgtactggaagcatttagaacttaccaatatatactgggataaatcgtttcaataaagtttatcaaat

SEQ ID NO: 376030 - DNA, 169 bp, Homo sapiens
taattcttttttatatgggtaatcttcggaagcatatagcattagcattcttattggtcatattggctgattcattctctctggcagaatgcccttctgcctgcagggttccggcagaagaaccagacatcaaagtccaccacagggccatttgatagagagcatctcc

SEQ ID NO: 376031 - DNA, 4980 bp, Homo sapiens
gcatgatttatgcctctcttgggctttagattttattcctttacttttctataactctgtcatgaccagtttaaaggccccaatgtcatgtcctcgcattaacaaccaaggctacaatgcaagccctgccatgtgcgcttctttacaaaaggtcaaagtaaaaaggaaatctataccaaagagcctctagatactatttccagcttcggggaagtccatagtaggtacttccacgggtagagaacattatcttagactgggataagggttggtattcgcagtccccttcctacgttctgcccattgtaaagaccagggtcagcgttgagcctcgcccttcttgctagaactacaactcccaggatgccccgcggcacgggagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagctttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattttttaaaatacatgaacttggcaagggtgtgatttttctttatcaagagaacaaaatgccagaatgttaaaacagttaactcaaaatctagtcatctgtgtaggagctaaagcaggtctccagggagagagggtggtcgtctgtgcattccaggttactgcacttgtctgatgtgacgtagcaacacccaggtcttcttaaaacaaagtcatcagctttgccaggttacatactttatttaaaagtatagtgaggtcgaagttcattccagtgtttcattttaataatgtgggcattattaaatttttgtggaagctaatagtaaaaaataaaagctgttttcaccacctccctccccaccccccaaaaaaggcgtacagccaactcttagttatttagggtaagagaaaaaagaaaactgttaaacaatgaaatcaaagataataaatatgatagatttccagtatgaggcacttgcaaaacagtcatttaaactgatggttactgtaagtcagttggaagctggcatgtatgtaaattacttggtgttacaccatatccgaagaagttcctatgtgcagtgcagaattgcataaacagtatttaatcactgctacaaatcttccaaccaagaaggaaaactgctattcttcataaatctaatttttagtatatgcttcctttcatcttatacttttatcaatatttataaaagtcatttctataataaaagcagtctttcttgctcaaagtattaaggtgaacaattgaatagagtactgtggtcgggagactgatttgagactgcagagctgatgctgggtagagggtctggacttgtattcatgttctgtctcagggcagcccctggagcaggagatggcagaggcatttacagctgcagaaaacagggaggaatggaatctgaggtagccctggcctcaaaattcaggcctggctgtatcatttacagagatttttctggagggaaaagtctcatttctgaggaaggcaaggtggctaatcattattaattttttttaaactttttgggccgggcgcagtggctcacgcctgtaatcccagcacttttgggaagccaaagtgggtggatcacttaaggtcaggagttcaagaccagcctggccaacatggtgaaaccctgtctctactaaaaatcaaaaaagtagccgggtgtggtggtgcacacctgtaatcccagctactcgggaggctgaggcaggagaattgcttgaacctgggagatggagattgcagtgagctgagatcgtaccactgcactgcagtctgggtgacaaagcaagactctgtctcaaaaaacaaacaaacaaacaaactttttgaaattgaattgcaatatgtctgctactttggcttgggctggacagtttatctaataagcaaggcagcttcttgtgtgctatggtaataagccttcttaacaggctaagcttccctcataagaactgtggtgtttctctttttttttttttgttttggtttgttttggttttttggtttggttttgttttgttttttaaatcagtatccaatgttttataggggccaaaggttaactttgcactattccctgtcagttaaaggccactgatatttttctaagttagcaaggctcacttgcttgctttcttgcctcccttgcctccatccctctcccttcctaccttctctatttacctatttctctccctccctctcttctcctctctttttttttcccccgcatatgcagctttttgattgtacttgattttatagagactgcacagttccagcaagattgggagtcaggcatggagcaggcatctcaggctaccagaaagaattggtcacctagactttcagtcaggcatcctcgtttgcattgtcctgtaagtcaattagttgataaatagttcccccttcatcccttaagttttgtttttgtttttgtttttaatataggtaagtgggactctacctaaaattttgcatcatacttatgggtaatatctttttcatatattatttatcaaagtatgaagttgagtattttgcttgtaccatttcaattctgcattatagtagttcattgtataactgaaagaaatgatttcttcataagtgacattaaatatgaacattcatccaattgaatttacaaaatctttccaaaattataagggagaaaaatcgggtttacttcaatctttaaaaatctggcacctcttagtaactttcagtatttctaaattgctctaaaattttataataaatagattagggttttgcaatagtcttaatttttaagccaaaggttttctgagaccttaggttttgtagtctaaccagcttatgtggttatttaaaagaatattctttgtgtttttaaattgctatttttaaaaaagctttttattacccattttataaaatgttatactcatatttgtctgaatttttccagtattcctacatgaaattgtatgtattaaaaactcaatattagtggcaaatattaatactattaaaatggattttggtgctatattcttgtagctaaagcctagtagaattctcaagaataggtgaaatacactttcaaagttgcctgtcatttaaaagaccaaataagcattttgtattaaataaattagcagatggttagagacttcaaggagagttagcttggtcatttaattgcgacttcatgttatttgattgaaataacccacatccttgctttgtataagatattcgctctggagaagttacatgtaaatagaattctataaattgttttccagttg

SEQ ID NO: 376032 - DNA, 4614 bp, Homo sapiens
gcatgatttatgcctctcttgggctttagattttattcctttacttttctataactctgtcatgaccagtttaaaggccccaatgtcatgtcctcgcattaacaaccaaggctacaatgcaagccctgccatgtgcgcttctttacaaaaggtcaaagtaaaaaggaaatctataccaaagagcctctagatactatttccagcttcggggaagtccatagtaggtacttccacgggtagagaacattatcttagactgggataagggttggtattcgcagtccccttcctacgttctgcccattgtaaagaccagggtcagcgttgagcctcgcccttcttgctagaactacaactcccaggatgccccgcggcacgggagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagctttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattttttaaaatacatgaacttggcaagggtgtgatttttctttatcaagagaacaaaatgccagaatgttaaaacagttaactcaaaatctagtcatctgtgtaggagctaaagcaggtctccctccccaccccccaaaaaaggcgtacagccaactcttagttatttagggtaagagaaaaaagaaaactgttaaacaatgaaatcaaagataataaatatgatagatttccagtatgaggcacttgcaaaacagtcatttaaactgatggttactgtaagtcagttggaagctggcatgtatgtaaattacttggtgttacaccatatccgaagaagttcctatgtgcagtgcagaattgcataaacagtatttaatcactgctacaaatcttccaaccaagaaggaaaactgctattcttcataaatctaatttttagtatatgcttcctttcatcttatacttttatcaatatttataaaagtcatttctataataaaagcagtctttcttgctcaaagtattaaggtgaacaattgaatagagtactgtggtcgggagactgatttgagactgcagagctgatgctgggtagagggtctggacttgtattcatgttctgtctcagggcagcccctggagcaggagatggcagaggcatttacagctgcagaaaacagggaggaatggaatctgaggtagccctggcctcaaaattcaggcctggctgtatcatttacagagatttttctggagggaaaagtctcatttctgaggaaggcaaggtggctaatcattattaattttttttaaactttttgggccgggcgcagtggctcacgcctgtaatcccagcacttttgggaagccaaagtgggtggatcacttaaggtcaggagttcaagaccagcctggccaacatggtgaaaccctgtctctactaaaaatcaaaaaagtagccgggtgtggtggtgcacacctgtaatcccagctactcgggaggctgaggcaggagaattgcttgaacctgggagatggagattgcagtgagctgagatcgtaccactgcactgcagtctgggtgacaaagcaagactctgtctcaaaaaacaaacaaacaaacaaactttttgaaattgaattgcaatatgtctgctactttggcttgggctggacagtttatctaataagcaaggcagcttcttgtgtgctatggtaataagccttcttaacaggctaagcttccctcataagaactgtggtgtttctctttttttttttttgttttggtttgttttggttttttggtttggttttgttttgttttttaaatcagtatccaatgttttataggggccaaaggttaactttgcactattccctgtcagttaaaggccactgatatttttctaagttagcaaggctcacttgcttgctttcttgcctcccttgcctccatccctctcccttcctaccttctctatttacctatttctctccctccctctcttctcctctctttttttttcccccgcatatgcagctttttgattgtacttgattttatagagactgcacagttccagcaagattgggagtcaggcatggagcaggcatctcaggctaccagaaagaattggtcacctagactttcagtcaggcatcctcgtttgcattgtcctgtaagtcaattagttgataaatagttcccccttcatcccttaagttttgtttttgtttttgtttttaatataggtaagtgggactctacctaaaattttgcatcatacttatgggtaatatctttttcatatattatttatcaaagtatgaagttgagtattttgcttgtaccatttcaattctgcattatagtagttcattgtataactgaaagaaatgatttcttcataagtgacattaaatatgaacattcatccaattgaatttacaaaatctttccaaaattataagggagaaaaatcgggtttacttcaatctttaaaaatctggcacctcttagtaactttcagtatttctaaattgctctaaaattttataataaatagattagggttttgcaatagtcttaatttttaagccaaaggttttctgagaccttaggttttgtagtctaaccagcttatgtggttatttaaaagaatattctttgtgtttttaaattgctatttttaaaaaagctttttattacccattttataaaatgttatactcatatttgtctgaatttttccagtattcctacatgaaattgtatgtattaaaaactcaatattagtggcaaatattaatactattaaaatggattttggtgctatattcttgtagctaaagcctagtagaattctcaagaataggtgaaatacactttcaaagttgcctgtcatttaaaagaccaaataagcattttgtattaaataaattagcagatggttagagacttc

SEQ ID NO: 376033 - DNA, 3408 bp, Homo sapiens
gcatgatttatgcctctcttgggctttagattttattcctttacttttctataactctgtcatgaccagtttaaaggccccaatgtcatgtcctcgcattaacaaccaaggctacaatgcaagccctgccatgtgcgcttctttacaaaaggtcaaagtaaaaaggaaatctataccaaagagcctctagatactatttccagcttcggggaagtccatagtaggtacttccacgggtagagaacattatcttagactgggataagggttggtattcgcagtccccttcctacgttctgcccattgtaaagaccagggtcagcgttgagcctcgcccttcttgctagaactacaactcccaggatgccccgcggcacgggagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagctttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatggtgttgaccaagaacatttttcaaatgtggtcaaaggtgaaaagattcttccggtatttgatgagccaccaaatccaaccaatgtagaagagagtttgaagagaactaaagaaaacgatgctcatcttgttgaagttaatttgaataatataaagaatatcccaattccaaccctaaaagattttgcaaaggctttggaaaccaacacacatgtgaaatgtttcagtcttgcagccacccggagcaatgaccctgttgctactgcttttgcagaaatgctgaaagtgaacaaaactttgaagagcttaaatgtggagtccaactttatcacgggagttgggattctggcactgattgatgcgttaagagataatgaaaccctggcagagctcaagattgacaatcagaggcagcagttggggacagctgtagaattggaaatggccaagatgcttgaggaaaatacaaatatccttaaatttggatatcagtttacacagcagggaccacgaaccagagcagctaatgctataacaaaaaacaatgacttagtgcgtaagagacgagttgaaggagatcaccagtaagtctgcaaaggtgtaatctttggaagacttcagaagatcaccaagggctcatgttggtgacatcatgtaaaattttcctgggtagaagggaaaagactggaaaaatttttttagtgacatgcattttttttttagttgttatcaaattgtaaaatcagtaatgtgatattttatattctgaaacatttctactttctgctaaaatcaattttaatttagtttaattgaatgatttatgatgaatcttgggcaaaaaaatacaactgtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattctttgcaagtttagtactgcccaaatttactcattctacagtgttactgcactttgaacgtattgacccatgtcacccaagagaagcaaacatatggatgcactagagacaactcgggttgctgctctcagttaagggctatgagttcttggggtctaagtatctgtaaaattatcctctccatcagctctcactgatcattaatgtttctggatatttcttaccctaagatttgcttaccaacaaatcaaagaaacgcttcactaattatttttaaattgagaaaatagtattcagaggcaaagatttttatattcttttttgagaccatgagactgtctcaaaaaacaaaacaaaacaaaaaaatgggtttttttgttgttgtttttgtcttttacttaggacacctgctctagaggctagataaaaatagattgtaatggccgggtgcagtggctcacacttgtaatcccagcacttgtccaggctggtctcgaactcctgacctcgtaatccacccgcctcggcctcccaaagtgctgggattacaggtgtttgccaccgcgcccagcccaaattattacattcgtaagacagacacctcttagaatctatatatatgaggttttactcccttttctacactcagtatgttttaattgatgcaaagcaattaattggcctaaaatgtttcaaatattatagtctatacattcagaaagtaaggtttaagaatgaattattggtgcttcttggtgggtgtatatagcagtttttagaagtttaaatttcacctctactcagaaagataagcttttgattcagtggtttcaaattttcagatcgatccatttaagaattgttttttcaaatgtatatacacgtataacataaaaatttttgtaatttcaaatgtctttttttcagttttttggatgaattattatatttggttttagttacatttaaaagcttgaaaattacctttctaacaatcatttgaatgtcattcattgtcacatgaaatcaggtatttacgtttttttctaatgctaaaatatccaacattgtaattgccctatttttccatttttataagtataaaagcaatgaattttaacactggtatttaaataatacaaaatattatccaaattcataacagcacagtgaagtttcttttgaagactatgtactggaagcatttagaacttaccaatatatactgggataaatcgtttcaataaagtttatcaaat

SEQ ID NO: 376034 - DNA, 2028 bp, Homo sapiens
cagcggtaccagccatgagaaggcccggaaaaggaagagctgaaaatggaggaaaccagagttagaactggtggataccggagaagaaaccgcagctgcactaccgaccccccccccaggtttgatgtccctccctctcttctcctctctttttttttcccccgcatatgcagctttttgattgtacttgattttatagagactgcacagttccagcaagattgggagtcaggcatggagcaggcatctcaggctaccagaaagaattggtcacctagactttcagtcaggcatcctcgtttgcattgtcctgtaagtcaattagttgataaatagttcccccttcatcccttaagttttgtttttgtttttgtttttaatataggtaagtgggactctacctaaaattttgcatcatacttatgggtaatatctttttcatatattatttatcaaagtatgaagttgagtattttgcttgtaccatttcaattctgcattatagtagttcattgtataactgaaagaaatgatttcttcataagtgacattaaatatgaacattcatccaattgaatttacaaaatctttccaaaattataagggagaaaaatcgggtttacttcaatctttaaaaatctggcacctcttagtaactttcagtatttctaaattgctctaaaattttataataaatagattagggttttgcaatagtcttaatttttaagccaaaggttttctgagaccttaggttttgtagtctaaccagcttatgtggttatttaaaagaatattctttgtgtttttaaattgctatttttaaaaaagctttttattacccattttataaaatgttatactcatatttgtctgaatttttccagtattcctacatgaaattgtatgtattaaaaactcaatattagtggcaaatattaatactattaaaatggattttggtgctatattcttgtagctaaagcctagtagaattctcaagaataggtgaaatacactttcaaagttgcctgtcatttaaaagaccaaataagcattttgtattaaataaattagcagatggttagagacttcaaggagagttagcttggtcatttaattgcgacttcatgttatttgattgaaataacccacatccttgctttgtataagatattcgctctggagaagttacatgtaaatagaattctataaattgttttccagttgaccgagtatctgttgtgtttttgtttaaaaagaggattccatgacataataaaaattattttaaaaaatgttttggtgctgggattacaggtgtttgccaccgcgcccagcccaaattattacattcgtaagacagacacctcttagaatctatatatatgaggttttactcccttttctacactcagtatgttttaattgatgcaaagcaattaattggcctaaaatgtttcaaatattatagtctatacattcagaaagtaaggtttaagaatgaattattggtgcttcttggtgggtgtatatagcagtttttagaagtttaaatttcacctctactcagaaagataagcttttgattcagtggtttcaaattttcagatcgatccatttaagaattgttttttcaaatgtatatacacgtataacataaaaatttttgtaatttcaaatgtctttttttcagttttttggatgaattattatatttggttttagttacatttaaaagcttgaaaattacctttctaacaatcatttgaatgtcattcattgtcacatgaaatcaggtatttacgtttttttctaatgctaaaatatccaacattgtaattgccctatttttccatttttataagtataaaagcaatgaattttaacactggtatttaaataatacaaaatattatccaaattcataacagcacagtgaagtttcttttgaagactatgtactggaagcatttagaacttaccaatatatactgggataaatcgtttcaataaagtttatcaaat

SEQ ID NO: 376035 - DNA, 1234 bp, Homo sapiens
gcatgatttatgcctctcttgggctttagattttattcctttacttttctataactctgtcatgaccagtttaaaggccccaatgtcatgtcctcgcattaacaaccaaggctacaatgcaagccctgccatgtgcgcttctttacaaaaggtcaaagtaaaaaggaaatctataccaaagagcctctagatactatttccagcttcggggaagtccatagtaggtacttccacgggtagagaacattatcttagactgggataagggttggtattcgcagtccccttcctacgttctgcccattgtaaagaccagggtcagcgttgagcctcgcccttcttgctagaactacaactcccaggatgccccgcggcacgggagtgcgcacgcgcgtcggaggcgaaggaggaacccaccgcacctacagggcggtcgagtgagggagctgctggcgggtgggtctggcaactctttgggaggccgacgcgggcggaccggcgggtgctgggaaccgagcctcggcttgcggccggcagtttccgtgggtctgtgaagaggtcggcggcccctgcgggcgccagtcagctttaagaaaaagtagagatcacttctgactgtactgaacagcaaaaattaagtgacttgctgccctgcacatcatggcactgccattccgtaaggacttagaaaagtacaaagaccttgatgaagatgagctccttgggaatctgtcagaaacagaactgaaacaactggaaactgttttggatgatcttgaccccgagaatgcccttctgcctgcagggttccggcagaagaaccagacatcaaagtccaccacagggccatttgatagagagcatctcctttcatatctggagaaagaagcattggagcataaagacagggaagactatgtgccctacactggagaaaaaaaagggaaaatatttatccccaaacagaaacctgtacagacttttacagaagaaaaagtgtctcttgatccagaattagaagaagctttgacaagtgcttctgatacagaattgtgtgacctcgcagcaattcttgggatgcacaatttgataacgaatacaaagttctgtaatataatgggaagtagtaatagtttatgctgtaatagtttatgctgtaatagcttatgctgtaatagtttatgctgtaatagtttatgctgtaatagtttatgctgtaatagtttatgctgta

SEQ ID NO: 376036 - DNA, 2182 bp, Homo sapiens
ccattagtgtacctctcattcataagaaaaaagtttctctgatttattgaactaagtatgcagtgcctactctatcaaaaaacaaaacaaaacatgttttgcactacactgagtcctatgttactatttttggcaaggaatgcatgtcttatgattttatgccattctcaatcctctactctccaatctaatttgcacgcacaacaacaacaaaaagctatgagaactctaagccacttagttttctctgctataaagttactgtagcttacttccaaggttatgtaaccaatattttctaataaatgcataataacatgatgtagcttggctacgtttaatagtcgaaagcgttcacatgttatctttctcactagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattggtaagcccttgggtctctcagacttaattggcaaagcacaatttaaaagcaagacagcacactaaaaaaattcctctatatgtgaatttcagatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatgatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttatagatattttatttttagatcggggaatagcacatagctactttggggcaacagggacttaaatatggcactgcaaactcattaacttttcttctttgtagttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattggtaaggaacaaaacatttatcatctaaggtgatttggcagtattaacaaatattagttcagactattaacagtgactcgtgagtgcattttttttcagctcgcccaagtgcacccaaagaattgaaatttggtgatataaccaaggac

SEQ ID NO: 376037 - DNA, 2289 bp, Homo sapiens
ccattagtgtacctctcattcataagaaaaaagtttctctgatttattgaactaagtatgcagtgcctactctatcaaaaaacaaaacaaaacatgttttgcactacactgagtcctatgttactatttttggcaaggaatgcatgtcttatgattttatgccattctcaatcctctactctccaatctaatttgcacgcacaacaacaacaaaaagctatgagaactctaagccacttagttttctctgctataaagttactgtagcttacttccaaggttatgtaaccaatattttctaataaatgcataataacatgatgtagcttggctacgtttaatagtcgaaagcgttcacatgttatctttctcactagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattggtaagcccttgggtctctcagacttaattggcaaagcacaatttaaaagcaagacagcacactaaaaaaattcctctatatgtgaatttcagatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatggtaagaagttttaagtaaattcaagttagcttttaagtaaattgcagtctttgccttcatcatcgttaccccaaactcatattttcttcttctgtggtgaaatccagatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttatagatattttatttttagatcggggaatagcacatagctactttggggcaacagggacttaaatatggcactgcaaactcattaacttttcttctttgtagttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattggtaaggaacaaaacatttatcatctaaggtgatttggcagtattaacaaatattagttcagactattaacagtgactcgtgagtgcattttttttcagctcgcccaagtgcacccaaagaattgaaatttggtgatataaccaaggac

SEQ ID NO: 376038 - DNA, 2081 bp, Homo sapiens
ccattagtgtacctctcattcataagaaaaaagtttctctgatttattgaactaagtatgcagtgcctactctatcaaaaaacaaaacaaaacatgttttgcactacactgagtcctatgttactatttttggcaaggaatgcatgtcttatgattttatgccattctcaatcctctactctccaatctaatttgcacgcacaacaacaacaaaaagctatgagaactctaagccacttagttttctctgctataaagttactgtagcttacttccaaggttatgtaaccaatattttctaataaatgcataataacatgatgtagcttggctacgtttaatagtcgaaagcgttcacatgttatctttctcactagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattggtaagcccttgggtctctcagacttaattggcaaagcacaatttaaaagcaagacagcacactaaaaaaattcctctatatgtgaatttcagatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatgatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttgttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattggtaaggaacaaaacatttatcatctaaggtgatttggcagtattaacaaatattagttcagactattaacagtgactcgtgagtgcattttttttcagctcgcccaagtgcacccaaagaattgaaatttggtgatataaccaaggac

SEQ ID NO: 376039 - DNA, 1199 bp, Homo sapiens
ggattgatgagactctgcatgtctgaggactcagatggttctagggtggctagaggatctctcatctagtaggctagtccaggcctcacatgtgacggagggttcccagttgcaagagagagtaagtcccaatgtacaaacattttcaagcctccaacagtgtcacatttgctattgtcccattggcaaagaaaatcacatggccaaaccctaaaccaacaagtggcaaagtcacaatgcagaggggtatacataccaggaggcatgaacaaattgtttgttattattaaaaccatcaacactttacttaggtttcctcttctgtagaaaaatgatttaccatctattggcctaaataacacaaagttgtttgcagtttttggcaattacaaagctgtaattaatgtataggtgttgtgtgaaacataggttttctgcctaggtcatttgctaagtttatatttagctttatagtaaactgcaaatttacttaccaaagtggttgaactgttttacgttcccatatatgagttccagttgctccacatcttcaccagcacttgatattgtcagtttttgttgatgctcattttgggctactgggtttttgttttatttgccattctaataagcatttacctgtatctcattgtagttttaattttcattttgctaatgactaatgatgttgagcatcttttcatgtgcatatttaccaaccgtatatcttctttggtgaagtgtctgttcatgtcttctgctctcttattttaaaattgagttgttattgttttcagagttgtttatatatcttatatacaagtcctttgtcacatatgtgattagctaatattttctccttttctatggcctgtgtcttttcattcttttaacagtgtcattcacagagcaaaaatgttttatttttatgaagtccaatttatcaattttttcttttagggactgccttggtgtcctatctaagaactttcttacaaaaccaaggttacaaagacttttcctgtattttcttctaaaaatcctagaattttatgttttacatttagatccattttacattttaaagtaatttctgtataaggtgttagggtttgcttgatactctttttttgcatataactgttcatttatttcagcattgcttattaaaaagtttgttcttcctccaaagaattgcc

SEQ ID NO: 376040 - DNA, 555 bp, Homo sapiens
cctccccttctgactgcaacacagctccacctgcaacctgagacctgggtgagcatctttgccctgccccgtgccattgttctggctatacaccagcgacctggacaggttttcacatctctatgctggatgggctggcccagccggttgtgcactgtgaggtgctgcaggaggagctgcgaggacacattcttcttgacttctcagcataggaatgtctcacgtccagtccacgtccctgtcctagtcctcctctctgctccttccacacttcctcacggtggtctcctgcacgctcgtggctgtcagtatcagacgagggcagcttctgcattttctcaattccaaccactcctctccacttacctacccagtatctctactgggtgtcttccagtcatcctgcactcaacgcgactgacaatttacttccaaccggctttacaatttccctgactttgttgatgggcaactttttccttccagttgcttaagccagatacgttgggagtcattctttaaccattctgttcaacttcatacctattcctcaag

SEQ ID NO: 376041 - DNA, 496 bp, Homo sapiens
cctccccttctgactgcaacacagctccacctgcaacctgagacctgggtgagcatctttgccctgccccgtgccattgttctggctatacaccagcgacctggacaggttttcacatctctatgctggatgggctggcccagccggttgtgcactgtgaggtgctgcaggaggagctgcgaggacacactgccagcttctgactctgattctttaatcttttctatagtcaggtaacccaggattgggacagcaaaacataagccctctactatcatatttgttgaatgtaagatttcctcagaatcaagaatatgaatagattatgcacttactgttcataattttaaattctaggatggctattatgattactttttgccttttctttggaccaaagaattttgtggtgctaaaagtgtcttttccatttccctttattatggagaacaaatccaagctttgtccggacaccagtggctccaacacctaatcc

SEQ ID NO: 376042 - DNA, 396 bp, Homo sapiens
gagtgaagtccctgctttaaagtgtactcctgtggacacagtaatacatatatttaaaatggttcatgttaagagtaggtatatttctatctaaatactctgtagcttttgtgattcagggaaatgagtggagcctcacaggcacaagaatctagtaaattctaggtttcttgtgtggaaatcagtgggcaaaatcttaactgagtgaattcttgattattggtatcacatttgttagtctgtatgtatctgtgtcatcgatctccttaagaagagactcgtagatattgactgggagacccaagctgaatgctaaaatctgctccatggatataagctgatgcagtcatcatttcacattaaaatgtaccacagctatatatgcagcaaaaaaaa

SEQ ID NO: 376043 - DNA, 348 bp, Homo sapiens
tagaagtttggtgatgtttttgtgacgagaaatatgttgcaggaacttaactcttgtttatatcaatcagcccatagtaaattggttttattaccagtggttttgcttaaagtcacagtttccaagaacctatcgatgataagtgaggacttactggacttaatactactgaactgtacacataaaaatggttaagatgatgaagtttacgtctattttaccacaatttttaaaaacgaaaaaaagaaatcctggggagtgagctgttcaaagaaggctttgaaaagctctgatacattccagagatctagacagctacacaggggcagggctttgtgcatggccatg

SEQ ID NO: 376044 - DNA, 362 bp, Homo sapiens
gtttgcttccccagagctccagggccattgctattgtcctctttcctgcacgcttcctcatttgcaaaacaatgtgaattctgttcttgcccttataattaaaggaaaaatgaggatgatcaagagtggttgcttcagggaccttccacactgctaaggccacctctatttttccagactcccaggtatattttaaaatgaagacatgtcaaaataggtttctgttgtagttaaaatgtttacacctattagcaattatatttgtatgagagttgaaggctcttccaacactgtcagtgtacttctgtgacagtatgtatctaaactcatttggaaataaacaataattgtctaattttggc

SEQ ID NO: 376045 - DNA, 1338 bp, Homo sapiens
gcatatggttggtgaacagttttgcagccctaggctcctgtactgtgcgcgcaccgccgcccgggcagccgctggctccagctcacgaaacagccccgggcgccgcgccgctctgagtccagcctcctactgagaacagtccctcccttgtgcgggtcgcacggctagccgcaggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcaaaaaaa

SEQ ID NO: 376046 - DNA, 903 bp, Homo sapiens
agcgggaaaaaaaacttatctgaggttggaaataaagagaaggtgacattggagcggatagaaaggaagaaacggcgtgggatctgggaatgaggcagtgggtggagagagaatggggagacgacagaggatgaagggcagctgagtgtgtctgcgggagaaggaccaaagcaatctgggcggagcaggtggcagaggcagccgcggaggaggcccagggaactgacggggatgctcagccaggcccagaggatgcgccctggcagtcccggaagacaccaggaaaacaagcaggaaccgtagctaggactggggtggccaggcccaggaaatccatgaagggcacagacagcgggtcctgctgccgccgccgatgcgactttggctgctgctgtcgcgcgtcccgccgggctcactacacgccttaccggtccggggacgcgacgcgaacccctcagtccccacggcagaccccgagccgggaaagacggcgcccggagccagccgggagctgggcagcagcggccgaggaggaagaagcagctgcggcggccacaccctggatgagagatggagtctcactgtgttgcctaggttggagtgaagtggtgcaatcatagctccctgcagtctccaactcctgggctcaagggatcctcttgccttggcctcccaagtagctgagatcacagttgtgtaccaccatttccggctacttttaaaaaattattttgtgtagagatggagtcttgctatgttgcctaggctggtctcaaactcctggcttcaagcaatcctaccaccccaccctcccaaagtgctgagactataggcatgagccactgcacccagccaagtctgtttcttaaactgataaatcacaggactactatataaacccag

SEQ ID NO: 376047 - DNA, 684 bp, Homo sapiens
  misc_feature (229)..(229): n is a, c, g, or t
cactgatgccgtagcatgacctgactcagaggatacccatccgatgtgccgctcctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagcggcanatgcgtcgcccctcatgttcttttcattccgcttcattctcgtcttttcagcatagacggcttgtatgctcactgtcaggctcgtaaccccgcacttgtggcctagtactgcgtctccaagcgctcattatcgattgtaatgtcaggtgagcgaggtctgaactcttactgagcgacctttgctttgtcttgcctgcctggaatgcttttcatgacaatagctttctattgtgtgaaatgttatacgatttcattctctacctccttacactcgcattcctatgcgttaatcctttagcgcttattcagttactttctcattttatttgtttttgcacactgttccttttttcattctggatatcttgtgcgttttatttcttattcattcagtccatctctctggttaggccgttcttttctttctcgcattttcctattactacggctcttcg

SEQ ID NO: 376048 - DNA, 1668 bp, Homo sapiens
aaggatccttaattttattaatccccccccccggagtcgtgtctcagcctggagagtgcgcgcaccgccgcccgggcagccgctggctccagctcacgaaacagccccgggcgccgcgccgctctgagtccagcctcctactgagaacagtccctcccttgtgcgggtcgcacggctagccgcaggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagttatagttccactgtattctactcaaaccttgtctgccatgccaactgtcaccacagaagaaagacccttacaatgtggaaggtaaaagttcaatttctaagctctgggcctgttcttcagaggttaaagaatctcctcatctccagtgaagccatccctggaatccctcactgattcagctggagtatggaggagcttaagttctaaagacctattcacttcctttaattccacctatacttcacaactgagaataccacaaacagttgggccctagaagaaagaagagctcacagatcttgcacttctaggtctgaattgtccaagtgaagaacgctaatttactccacatcccacagataactatctctcaagtgatcccagtatgaaagtctggagtatgagtataatatactcactgtaatatctgagtacaggaagttcacttcaga

SEQ ID NO: 376049 - DNA, 990 bp, Homo sapiens
aaggatccttaattttattaatccccccccccggagtcgtgtctcagcctggagagtgcgcgcaccgccgcccgggcagccgctggctccagctcacgaaacagccccgggcgccgcgccgctctgagtccagcctcctactgagaacagtccctcccttgtgcgggtcgcacggctagccgcaggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaattccggcctagcaaaagaatgaaaactttctcgggatggggaaccttctggttggaaagacagaaa

SEQ ID NO: 376050 - DNA, 1066 bp, Homo sapiens
gcctacagttgggcctgggaggctccaggagggtgacagcagagtcctggcttggagtcgggttacaccacttgtgtctgagttcacgcagcatgttcctctgtcagggattccgcaaatatctccctgagcacctcaatgacctgaagaaggagaacttcagcctcaagctgcgcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagtaggtgccttcggtgctctttttgtcgcttgtcttttgcccattctcaaggcatacagcagctgtcctgttccctttcaaggactgacagtaggagcttcactatttctaagactttatgggcccacaaccgaagacattcttttcagggttgaattttcagtggtatccattatgaaaactcacttcatggattcagtgggcaaatagcggcaagcaagagacatggattcacttattcggcaaacatttactgggcatgccacatgccagataccgggctaagtatctggcatgtgttacagaaacaaaagacctaaatcttgtcaccaagaaacatgttacatgattttaataagttccctgatagaagagcatggggtgctctggggaaatattggagggtcatccattccacattaaaagagcaagttgtcaaatgtggtc

SEQ ID NO: 376051 - DNA, 498 bp, Homo sapiens
  misc_feature (424)..(424): n is a, c, g, or t
gcatatggttggtgaacagttttgcagccctaggctcctgtactgtgcgcgcaccgccgcccgggcagccgctggctccagctcacgaaacagccccgggcgccgcgccgctctgagtccagcctcctactgagaacagtccctcccttgtgcgggtcgcacggctagccgcaggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagcggcanatgcgttggggtatcctcaagagtcgaggtgcatactgatgtagtcagtcggtaagaaagccgataataagtca

SEQ ID NO: 376052 - DNA, 1161 bp, Homo sapiens
gcacccagagcagtgagcccagtcccgagtcccggagagagctccagcaataggggccatgtcgccgtagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagtaggtgccttcggtgctctttttgtcgcttgtcttttgcccattctcaaggcatacagcagctgtcctgttccctttcaaggactgacagtaggagcttcactatttctaagactttatgggcccacaaccgaagacattcttttcagggttgaattttcagtggtatccattatgaaaactcacttcatggattcagtgggcaaatagcggcaagcaagagacatggattcacttattcggcaaacatttactgggcatgccacatgccagataccgggctaagtatctggcatgtgttacagaaacaaaagacctaaatcttgtcaccaagaaacatgttacatgattttaataagttccctgatagaagagcatggggtgctctggggaaatattggagggtcatccattccacattaaaagagcaagttgtcaaatgtggtc

SEQ ID NO: 376053 - DNA, 1131 bp, Homo sapiens
agcgggaaaaaaaacttatctgaggttggaaataaagagaaggtgacattggagcggatagaaaggaagaaacggcgtgggatctgggaatgaggcagtgggtggagagagaatggggagacgacagaggatgaagggcagctgagtgtgtctgcgggagaaggaccaaagcaatctgggcggagcaggtggcagaggcagccgcggaggaggcccagggaactgacggggatgctcagccaggcccagaggatgcgccctggcagtcccggaagacaccaggaaaacaagcaggaaccgtagctaggactggggtggccaggcccaggaaatccatgaagggcacagacagcgggtcctgctgccgccgccgatgcgactttggctgctgctgtcgcgcgtcccgccgggctcactacacgccttaccggtccggggacgcgacgcgaacccctcagtccccacggcagaccccgagccgggaaagacggcgcccggagccagccgggagctgggcagcagcggccgaggaggaagaagcagctgcggcggccacaccctggatgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggcaattgcctacccaaaccctaggcccagccgactttggaggtctccagttgaaccttcaccttttactggaatggagcagtctctgcaagaggggttggtggaagtaggaagcaaaaaaattgagaaaagaaacagtaagaagaggaagttcttgcagggagaattgtttttcaagagagctatatttttattttgaacagcatccatttgtttgataaatatatcattatcttctgtgtgtgg

SEQ ID NO: 376054 - DNA, 1544 bp, Homo sapiens
aaggatccttaattttattaatccccccccccggagtcgtgtctcagcctggagagtgcgcgcaccgccgcccgggcagccgctggctccagctcacgaaacagccccgggcgccgcgccgctctgagtccagcctcctactgagaacagtccctcccttgtgcgggtcgcacggctagccgcaggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagtaggtgccttcggtgctctttttgtcgcttgtcttttgcccattctcaaggcatacagcagctgtcctgttccctttcaaggactgacagtaggagcttcactatttctaagactttatgggcccacaaccgaagacattcttttcagggttgaattttcagtggtatccattatgaaaactcacttcatggattcagtgggcaaatagcggcaagcaagagacatggattcacttattcggcaaacatttactgggcatgccacatgccagataccgggctaagtatctggcatgtgttacagaaacaaaagacctaaatcttgtcaccaagaaacatgttacatgattttaataagttccctgatagaagagcatggggtgctctggggaaatattggagggtcatccattccacattaaaagagcaagttgtcaaatgtggtc

SEQ ID NO: 376055 - DNA, 1320 bp, Homo sapiens
aaggatccttaattttattaatccccccccccggagtcgtgtctcagcctggagagtgcgcgcaccgccgcccgggcagccgctggctccagctcacgaaacagccccgggcgccgcgccgctctgagtccagcctcctactgagaacagtccctcccttgtgcgggtcgcacggctagccgcaggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaa

SEQ ID NO: 376056 - DNA, 1711 bp, Homo sapiens
agcgggaaaaaaaacttatctgaggttggaaataaagagaaggtgacattggagcggatagaaaggaagaaacggcgtgggatctgggaatgaggcagtgggtggagagagaatggggagacgacagaggatgaagggcagctgagtgtgtctgcgggagaaggaccaaagcaatctgggcggagcaggtggcagaggcagccgcggaggaggcccagggaactgacggggatgctcagccaggcccagaggatgcgccctggcagtcccggaagacaccaggaaaacaagcaggaaccgtagctaggactggggtggccaggcccaggaaatccatgaagggcacagacagcgggtcctgctgccgccgccgatgcgactttggctgctgctgtcgcgcgtcccgccgggctcactacacgccttaccggtccggggacgcgacgcgaacccctcagtccccacggcagaccccgagccgggaaagacggcgcccggagccagccgggagctgggcagcagcggccgaggaggaagaagcagctgcggcggccacaccctggatgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagtaggtgccttcggtgctctttttgtcgcttgtcttttgcccattctcaaggcatacagcagctgtcctgttccctttcaaggactgacagtaggagcttcactatttctaagactttatgggcccacaaccgaagacattcttttcagggttgaattttcagtggtatccattatgaaaactcacttcatggattcagtgggcaaatagcggcaagcaagagacatggattcacttattcggcaaacatttactgggcatgccacatgccagataccgggctaagtatctggcatgtgttacagaaacaaaagacctaaatcttgtcaccaagaaacatgttacatgattttaataagttccctgatagaagagcatggggtgctctggggaaatattggagggtcatccattccacattaaaagagcaagttgtcaaatgtggtc

SEQ ID NO: 376057 - DNA, 984 bp, Homo sapiens
atgcctgtaatcccagcactttgggaggccaaggcgggcggatctcaagcacctcaatgacctgaagaaggagaacttcagcctcaagctgcgcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagtaggtgccttcggtgctctttttgtcgcttgtcttttgcccattctcaaggcatacagcagctgtcctgttccctttcaaggactgacagtaggagcttcactatttctaagactttatgggcccacaaccgaagacattcttttcagggttgaattttcagtggtatccattatgaaaactcacttcatggattcagtgggcaaatagcggcaagcaagagacatggattcacttattcggcaaacatttactgggcatgccacatgccagataccgggctaagtatctggcatgtgttacagaaacaaaagacctaaatcttgtcaccaagaaacatgttacatgattttaataagttccctgatagaagagcatggggtgctctggggaaatattggagggtcatccattccacattaaaagagcaagttgtcaaatgtggtc

SEQ ID NO: 376058 - DNA, 1122 bp, Homo sapiens
gaacatctaacatgagatctaccctcttaacaattttttaagtgtacaatacagtattgctaactataggcatgaggatgtgcagcagatctctggaacgtttcactctttataactgaagctttataccccttgaatcgcagtttcccatttccctgtcttcatagcccctggcatccaccattctacactctttctatggggttgactattttaattacctgacacaagtggaatcatgcattatttgtctttctgtgactggtttatttcatgtagcataaagtcatcaaggttcatccatgtttttgcatatggcaaggtttcctttttaagtctgaataatattccattttctacatataccacatttactttatccctttttctgttagtggacatttaacttgttctcacagcttggctattgcaaataatgctgcaatgaatatctcataagtctcgtatatgtccatacaagatcatgaaaatggacatgtctctgggtattttgaattggtgggacaattttgcttaagggtaggcatagtgggtggctctacatttgagagttctaattcccattcctatatatatttcttttctttttatttatttatttttttgagatggggttctctgtcactcaggctggagtgcagtggcacaaacatggcttactgcagcctcaacctcctgggctcaagtgatcctcccatctcagcctcccaagaagctgggaccacaggcatgtgtcaccatgcctgactaattttttttaattttctgtaagcatggggtcttgctatgttgcctaggctggtctcaaactcctgggctcaagtgatcctcatgcctcagcctcccaaagtgctgggattacatgtgtaggccaccacacccagccttatatatgtatttctaattttgccttagccatgcccttaaaaactaattatactttcaactagtttttttttccaccttcagtctgtggtattgttcacattttgaaaacaatacctacagtaacctgtgaggtaggacatgatagtgttttattggaccccttttactttatgaattggaaaaactaaatttgcatgtagtttgtaaaaaaaa

SEQ ID NO: 376059 - DNA, 252 bp, Homo sapiens
aatatcaaaagaccagcaaaagaaaatatgatctgtgatatatacagagaaagcatttgataaaattgaaaatccattcttggtaaaaagctctcagcaaaactaataataaacagaaactttctcaacatgacaaagggattttacagaaaacctaaagctaaaataatagtgaataataatgaaatatttaatgtttaagattgggaaaaaaaggaaagaaaggatatctactctcaccacttattttca

SEQ ID NO: 376060 - DNA, 426 bp, Homo sapiens
tgtaaaatattgtagaataccaaatattttatttttatgtctgtgattcccttttggatagagagtcttctgggcttcagagtatggctcacatataatatatggcctgtatttccatctctctctttttgcatcagaatattctattggtttaaggaatcttgccatagcttgccataattttgtatatttgtgtcttgcaggcatgctgtgcctacaagcatgctttgtagtatattttctgatttgtaaatagtacagttttaactgaagtgtagatgttccagggaaatatttaaccaatacattgtcatgcagtttcataaagtgatgttgtcagtttatcatggagaaggcaaatattgttcagggctgtgagagaatgtgattgctactcagtaaacggagatgctatttaaatgaatc

SEQ ID NO: 376061 - DNA, 1040 bp, Homo sapiens
atgacatttccggtggcatctggggcaaacgacacaagtcagcatttagtttcttgctttaggaagcggaagactaatgaccgaagcttcaagactttgacatgtgtgaaaacatgaaatggtaagtcaatacaaagacagcatcttcctggaatttggttttgagcttgttttcatttcacctttctcagtaatctgggtgtagcttattttgactcttcctttgattaaacaattcagacccttggctcttattgttcttgctggtgtggtatgttcacggctgaaaagatggtcagaaggggaaaggaggaagtgagaagaaagaaacagggaaatggacagagtgttgctcagttacccaggctggagtgcaatggcatgatcttggctcactgcagcctccacctcctgggttcaagcggttctcgtgcctcagtctcccaagtagctgggattacaggctggagtgcgatggcatgatcttggctcacggcaaactccgcctccctggttcaagtgattctcctgcctcagcctcccgagtagccgggattacaggcatgtgccaccatgccccgttggccaggctggtctcgaacaccttacctcaggtgatcctcccacctttgggattacagcaggctgaggaattaccaaggaggcaggaggtggagcaaaacacaccaagcctggtgccaatcattgacaatattatggttagtacttactgagggctgactatggttgaaactgcctttgcaaaattatgactgagacggtgaaagagatctaacttaaccaacgctagctatcttgcctctaacctccaagctgtccttgttcattcctgggcataggctgaactaactttgggagaaatttagtttatagtttgaaacaaagatgataacagccctttgccaaagcagacctccttcttgtctggggactagatggcctttgtaggactaacatgagccacaagattagaaattatggataggagtcatgcagctggagtctccaagattctgacc

SEQ ID NO: 376062 - DNA, 1073 bp, Homo sapiens
atgacatttccggtggcatctggggcaaacgacacaagtcagcatttagtttcttgctttaggaagcggaagactaatgaccgaagcttcaagactttgacatgtgtgaaaacatgaaatggtaagtcaatacaaagacagcatcttcctggaatttggttttgagcttgttttcatttcacctttctcagtaatctgggtgtagcttattttgactcttcctttgattaaacaattcagacccttggctcttattgttcttgctggtgtggtatgttcacggctgaaaagatggtcagaaggggaaaggaggaagtgagaagaaagaaacagggaaatggtaagaagaactctacttttctaaataatatttaatagtagtaatcttgtgtttctgtgcaaggtgttacagtttacaaaccgcttttatttttatttatttatttgacagagtgttgctcagttacccaggctggagtgcaatggcatgatcttggctcactgcagcctccacctcctgggttcaagcggttctcgtgcctcagtctcccaagtagctgggattacaggctggagtgcgatggcatgatcttggctcacggcaaactccgcctccctggttcaagtgattctcctgcctcagcctcccgagtagccgggattacaggcatgtgccaccatgccccgttggccaggctggtctcgaacaccttacctcaggtgatcctcccacctttgggattacagcaggctgaggaattaccaaggaggcaggaggtggagcaaaacacaccaagcctggtgccaatcattgacaatattatgaccctgcatgtgatggatcagctgacaccatccagatcggtaaactggttcatctgatcttgtgccctccacccaggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgca

SEQ ID NO: 376063 - DNA, 967 bp, Homo sapiens
atgacatttccggtggcatctggggcaaacgacacaagtcagcatttagtttcttgctttaggaagcggaagactaatgaccgaagcttcaagactttgacatgtgtgaaaacatgaaatggtaagtcaatacaaagacagcatcttcctggaatttggttttgagcttgttttcatttcacctttctcagtaatctgggtgtagcttattttgactcttcctttgattaaacaattcagacccttggctcttattgttcttgctggtgtggtatgttcacggctgaaaagatggtcagaaggggaaaggaggaagtgagaagaaagaaacagggaaatggacagagtgttgctcagttacccaggctggagtgcaatggcatgatcttggctcactgcagcctccacctcctgggttcaagcggttctcgtgcctcagtctcccaagtagctgggattacaggctggagtgcgatggcatgatcttggctcacggcaaactccgcctccctggttcaagtgattctcctgcctcagcctcccgagtagccgggattacaggcatgtgccaccatgccccgttggccaggctggtctcgaacaccttacctcaggtgatcctcccacctttgggattacagcaggctgaggaattaccaaggaggcaggaggtggagcaaaacacaccaagcctggtgccaatcattgacaatattatgaccctgcatgtgatggatcagctgacaccatccagatcggtaaactggttcatctgatcttgtgccctccacccaggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgca

SEQ ID NO: 376064 - DNA, 954 bp, Homo sapiens
atgacatttccggtggcatctggggcaaacgacacaagtcagcatttagtttcttgctttaggaagcggaagactaatgaccgaagcttcaagactttgacatgtgtgaaaacatgaaatgacccttggctcttattgttcttgctggtgtggtatgttcacggctgaaaagatggtcagaaggggaaaggaggaagtgagaagaaagaaacagggaaatggtaagaagaactctacttttctaaataatatttaatagtagtaatcttgtgtttctgtgcaaggtgttacagtttacaaaccgcttttatttttatttatttatttgacagagtgttgctcagttacccaggctggagtgcaatggcatgatcttggctcactgcagcctccacctcctgggttcaagcggttctcgtgcctcagtctcccaagtagctgggattacaggctggagtgcgatggcatgatcttggctcacggcaaactccgcctccctggttcaagtgattctcctgcctcagcctcccgagtagccgggattacaggcatgtgccaccatgccccgttggccaggctggtctcgaacaccttacctcaggtgatcctcccacctttgggattacagcaggctgaggaattaccaaggaggcaggaggtggagcaaaacacaccaagcctggtgccaatcattgacaatattatgaccctgcatgtgatggatcagctgacaccatccagatcggtaaactggttcatctgatcttgtgccctccacccaggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgca

SEQ ID NO: 376065 - DNA, 1251 bp, Homo sapiens
atgacatttccggtggcatctggggcaaacgacacaagtcagcatttagtttcttgctttaggaagcggaagactaatgaccgaagcttcaagactttgacatgtgtgaaaacatgaaatggtaagtcaatacaaagacagcatcttcctggaatttggttttgagcttgttttcatttcacctttctcagtaatctgggtgtagcttattttgactcttcctttgattaaacaattcagacccttggctcttattgttcttgctggtgtggtatgttcacggctgaaaagatggtcagaaggggaaaggaggaagtgagaagaaagaaacagggaaatggtaagaagaactctacttttctaaataatatttaatagtagtaatcttgtgtttctgtgcaaggtgttacagtttacaaaccgcttttatttttatttatttatttgacagagtgttgctcagttacccaggctggagtgcaatggcatgatcttggctcactgcagcctccacctcctgggttcaagcggttctcgtgcctcagtctcccaagtagctgggattacaggctggagtgcgatggcatgatcttggctcacggcaaactccgcctccctggttcaagtgattctcctgcctcagcctcccgagtagccgggattacaggcatgtgccaccatgccccgttggccaggctggtctcgaacaccttacctcaggtgatcctcccacctttgggattacagcaggctgaggaattaccaaggaggcaggaggtggagcaaaacacaccaagcctggtgccaatcattgacaatattatgaccctgcatgtgatggatcagctgacaccatccagatcggtaaactggttcatctgatcttgtgccctccacccaggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgcaaaaaaaaattggccccattgccctaagcggggagcttttgccgtcctttcccttttcgaaggtttattattgaccctcgctcctgcctgctgcgcttgctcctctggtgacgcaaccgcatcagccaacttaaggggttacaacgtttcccctgatttgggggcaccgctgaaataca

SEQ ID NO: 376066 - DNA, 1256 bp, Homo sapiens
tcaggcagctggaaggtgtgcccctgggcctcacacagctctggggaggtggcacagggcttcctctttcatagagctaattaggttcttatctgtgctaccagatgagcccagctgccagctccttacttcatctcaaccaatccaacaggctattcaaaccaacactgatattattctagcaatatgtttatgtattttggacaaaagtttaaagtaatttagtcctccatctgtcaccttcaggctaaagtcctttattttcttggtgcattgaccatggggctccatctaggctctgaaaggatattccctcaaggccctgagctagagaccacagggtaactctacatgctgttctcctaataagattttggtaacatctgattgtttgctaaaatcccattcaaagctccttctacctgggcagagcctgccaagttgagttcagcttcagttggatgagtatgtcaaagtccctggccattcgaatagccatttacctaaggcaagagcaaatgctggctaaagcatctaatcaccatttatttatgttggtgatgttgggatttgagagcacagagtggaaggtagaaacagggtagtgtctgtaactaccgtcagatctacttcttcactttcatttttaacatacaaggtccttaaaaaaaccttggatttttttttgttgcgggggcggggtagagatgaggtttcgctatattgaccaggctggtcttgaactcctggcctcaagtgatccttctgcctcagtcccccaaagaaaacctagcagttgaaaaaatgatcaattcatataaagagaaactgaaaaaagacttttgccttgtccccagcaggctgaggaattaccaaggaggcaggaggtggagcaaaacacaccaagcctggtgccaatcattgacaatattatggttagtacttactgagggctgactatggttgaaactgcctttgcaaaattatgactgagacggtgaaagagatctaacttaaccaacgctagctatcttgcctctaacctccaagctgtccttgttcattcctgggcataggctgaactaactttgggagaaatttagtttatagtttgaaacaaagatgataacagccctttgccaaagcagacctccttcttgtctggggactagatggcctttgtaggactaacatgagccacaagattagaaattatggataggagtcatgcagctggagtctccaagattctgacc

SEQ ID NO: 376067 - DNA, 642 bp, Homo sapiens
atgacatttccggtggcatctggggcaaacgacacaagtcagcatttagtttcttgctttaggaagcggaagactaatgaccgaagcttcaagactttgacatgtgtgaaaacatgaaatggtaagtcaatacaaagacagcatcttcctggaatttggttttgagcttgttttcatttcacctttctcagtaatctgggtgtagcttattttgactcttcctttgattaaacaattcagacccttggctcttattgttcttgctggtgtggtatgttcacggctgaaaagatggtcagaaggggaaaggaggaagtgagaagaaagaaacagggaaatggtaagaagaactctacttttctaaataatatttaatagtagtaatcttgtgtttctgtgcaaggtgttacagtttacaaaccgcttttatttttatttatttattttttttgagacggagttttggtcttgttgcactccagtcagggtgacaagagcaagactccatctttaaaaaaaaaaaaagggtgggggagatggtcttctgattgattagataagtgtaggcatttgttttcttttgtctggaataatatgatttcggggagaggaatatcactttccctacaaataccaagatga

SEQ ID NO: 376068 - DNA, 594 bp, Homo sapiens
atgacatttccggtggcatctggggcaaacgacacaagtcagcatttagtttcttgctttaggaagcggaagactaatgaccgaagcttcaagactttgacatgtgtgaaaacatgaaatgacccttggctcttattgttcttgctggtgtggtatgttcacggctgaaaagatggtcagaaggggaaaggaggaagtgagaagaaagaaacagggaaatggacagagtgttgctcagttacccaggctggagtgcaatggcatgatcttggctcactgcagcctccacctcctgggttcaagcggttctcgtgcctcagtctcccaagtagctgggattacagcaggctgaggaattaccaaggaggcaggaggtggagcaaaacacaccaagcctggtgccaatcattgacaatattatggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgca

SEQ ID NO: 376069 - DNA, 547 bp, Homo sapiens
atgacatttccggtggcatctggggcaaacgacacaagtcagcatttagtttcttgctttaggaagcggaagactaatgaccgaagcttcaagactttgacatgtgtgaaaacatgaaatgacccttggctcttattgttcttgctggtgtggtatgttcacggctgaaaagatggtcagaaggggaaaggaggaagtgagaagaaagaaacagggaaatgcaggctgaggaattaccaaggaggcaggaggtggagcaaaacacaccaagcctggtgccaatcattgacaatattatgaccctgcatgtgatggatcagctgacaccatccagatcggtaaactggttcatctgatcttgtgccctccacccaggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgca

SEQ ID NO: 376070 - DNA, 493 bp, Homo sapiens
atgacatttccggtggcatctggggcaaacgacacaagtcagcatttagtttcttgctttaggaagcggaagactaatgaccgaagcttcaagactttgacatgtgtgaaaacatgaaatgacccttggctcttattgttcttgctggtgtggtatgttcacggctgaaaagatggtcagaaggggaaaggaggaagtgagaagaaagaaacagggaaatgcaggctgaggaattaccaaggaggcaggaggtggagcaaaacacaccaagcctggtgccaatcattgacaatattatggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgcaacaaaaaaaaaagtcgtatcga

SEQ ID NO: 376071 - DNA, 1061 bp, Homo sapiens
atgacatttccggtggcatctggggcaaacgacacaagtcagcatttagtttcttgctttaggaagcggaagactaatgaccgaagcttcaagactttgacatgtgtgaaaacatgaaatggtaagtcaatacaaagacagcatcttcctggaatttggttttgagcttgttttcatttcacctttctcagtaatctgggtgtagcttattttgactcttcctttgattaaacaattcagacccttggctcttattgttcttgctggtgtggtatgttcacggctgaaaagatggtcagaaggggaaaggaggaagtgagaagaaagaaacagggaaatggtaagaagaactctacttttctaaataatatttaatagtagtaatcttgtgtttctgtgcaaggtgttacagtttacaaaccgcttttatttttatttatttatttgacagagtgttgctcagttacccaggctggagtgcaatggcatgatcttggctcactgcagcctccacctcctgggttcaagcggttctcgtgcctcagtctcccaagtagctgggattacagacgaaatcttgctctgttgcccaggctggagtgcgatggcatgatcttggctcacggcaaactccgcctccctggttcaagtgattctcctgcctcagcctcccgagtagccgggattacaggcatgtgccaccatgccccgttggccaggctggtctcgaacaccttacctcaggtgatcctcccacctttgggattacagcaggctgaggaattaccaaggaggcaggaggtggagcaaaacacaccaagcctggtgccaatcattgacaatattatggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgcaaaaacaaaaacaatggcctccttcgcctcaccgcggaacc

SEQ ID NO: 376072 - DNA, 685 bp, Homo sapiens
gaaccaatgagattgcgtgtataacatctgctggctcactgagtgacacaaaggaagtgctccacgagtgttgattactctctgagtactgctttttctgatctagcaatctggttctctggggttgggaaagtcagaataagatatttcagataccaccagagttaccattagcattttggtatgttttgtttctctccatctgtatttttaatcatagttgtaattatgattatatatatgtaaatatatatgtctgcgtatgtgtgttttgtgtatccgtatacacacacctatacaaatgatgttttcacattatgtcataagcatttctctgctactgtatgattttcatactcactatttgtagtcactacaaagtgttaggttggagaagttttgctgttggagcctgagggtaagaaaatgttagtctcttcaaaatagaatcagtgagtactagaataggtagtgattttgaaatgtcaggaagagattaattattattctttttaaagtatattctctttttgtaaccttagtcatttattcctgaatttggggagaacccaccagaagcctggcggtccactgtggatggggcagtaaacaggctggcaggtgtctccggaagcttacgttctgagtttagtgggtagaggtaaagaaagaagattaaaaaaaa

SEQ ID NO: 376073 - DNA, 309 bp, Homo sapiens
acctgccctcccgctctggtatttctgttctcagtgaatggggtcatcatccacccaggcatccatgtcagaaactcggcagccctcctggaatcctccgtctccctccctgctctccccattccttccgaatctctaagtcctacagattccactgtgttcacacactcataactgtttcttccatcccaactccagagcttctgtgttaatgtgctgcttcttcatttctccaccagattcttccaacagcctcctcactattctccctacatacatagagtcctggccccccagtccattcttctc

SEQ ID NO: 376074 - DNA, 476 bp, Homo sapiens
atatatatatatatacacacattaggaaagatggactaactacaacccaagtagagaaagtatgaacaaggcctgctggacagttatacaaccttgcactcaacaactgttctcttcaatcacatggaacgtgtgcaaaaactgcccatatactgggccataaagcaaatttcaaaggactgaaattatgccaagtatattgtctgactccaaggcaattatactagaaaaaaatgactagaaaaatccccatatgggctgggcacagtagctgatgcctgtaatcccaacactctggaaggccaagataggcagaccaattgaggccaggctggtctcgaactcctgacctcgtgatccaccggcctcagcctcccaaagcgctgggattacaggcgtgagccaccgtgcccagcggagaccctgtcttaaaaaagccaggcactccagcctgggcaacaagagtgaaactgtct

SEQ ID NO: 376075 - DNA, 1528 bp, Homo sapiens
ctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagat

SEQ ID NO: 376076 - DNA, 3197 bp, Homo sapiens
ctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgattataggaatccaggatgttgaagaaatggcataatgtctatattttggaaacagaaaggaaaagtcacttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacacctttttttttttttctgatgcagagttcaggttaatattttactgcatctgataatgtattatacgtttgaagcctagtgacttttcattttgacattcttgtgatttcatatgctgtattcttcaagcaataaaattgtgatgtgtctcatcactggttttt

SEQ ID NO: 376077 - DNA, 3110 bp, Homo sapiens
ctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgattataggaatccaggatgttgaagaaatggcataatgtctatattttggaaacagaaaggaaaagtcacttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacacctttttttttttttctgatgcagagttcaggttaatattttactgcatctgataatgtattatacgtttgaagcctagtgacttttcattttgacattcttgtgatttcatatgctgtattcttcaagcaataaaattgtgatgtgtctcatcactggttttt

SEQ ID NO: 376078 - DNA, 3262 bp, Homo sapiens
  misc_feature (164)..(164): n is a, c, g, or t
ctggcatctggagggaccaccgttgccgcgtcttcggcttccacgatctgcgttcgggctacgcggccacggcggcagccactgcgactcccactgtgcctggctctgtccatattagttcccaggcggccgtcgccgttccatgcatgctgtgctgctgtgcnatgctgtgcatgctgtgctgtgacattgtttgttgatgtgctgtgctgtgctgctgtgtgtgtcttgaagtgattgtgttttgtgtcctgagtgctgtgctgtgcaaactgtgccttgctttggctgtgctgtgctgtgccagctgtgcatggcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgattataggaatccaggatgttgaagaaatggcataatgtctatattttggaaacagaaaggaaaagtcacttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacacctttttttttttttctgatgcagagttcaggttaatattttactgcatctgataatgtattatacgtttgaagcctagtgacttttcattttgacattcttgtgatttcatatgctgtattcttcaagcaataaaattgtgatgtgtctcatcactggttttt

SEQ ID NO: 376079 - DNA, 2911 bp, Homo sapiens
  misc_feature (44)..(44): n is a, c, g, or t
  misc_feature (57)..(57): n is a, c, g, or t
  misc_feature (153)..(153): n is a, c, g, or t
aacctatcataggcactaaagaggaaaagcctttgaagcaggcnttagtacatgcantgttataattcatatgaatatgaggtacaaaagaagaggtgttgatgttttaaaaacattaatggctatttattgatattgcagaccacctagagnatgctaaattgaacatttagtgacagaagattttctcctggatactttaaatacataaaaacttggcagagtttttatgaaatataaattttattgtattcatttacatattaaaaaatagactcagaggcggaaaaacttccttgaaattgtttgtcatttgttctacagttacttactgaagtcattactatttaccaagcatcatgctaggtgctaggcttacaagagtgaacaaggagacagggttcctgtcattatagagcttaatctactggggaagattgagtgggaaagattgacttaaataaaacagtaagttcagaaagttaggaagtgttggagtctatatttaaacttaggtattttgacccaaaagcctgtactgtttctaacataccatgctgatgctctagcctccattttatatgcttaaacttattatggggcttttaaatagaatatgtattatccttgccagggcaaaatataaagaaataattgactgcctgctatatctgtcttcacctttctatccctattatctgtttttttattcctcttttttgtctcccttgtttcttaccctgacttatgtatgaagatctctagtatttctttactattgtgaggatgaccagcggagaggctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgattataggaatccaggatgttgaagaaatggcataatgtctatattttggaaacagaaaggaaaagtcacttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacacctttttttttttttctgatgcagagttcaggttaatattttactgcatctgataatgtattatacgtttgaagcctagtgacttttcattttgacattcttgtgatttcatatgctgtattcttcaagcaataaaattgtgatgtgtctcatcactggttttt

SEQ ID NO: 376080 - DNA, 2086 bp, Homo sapiens
ctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcggcgagcaacacacctccccacgggggggcccaacacacacgacccgcacactcttctatgacaaaaagggcggccacacagagggtgcgcaacatcaaacgccacggcgcggcgcccggcacacacaccgaccgcaggcgggaggaaaacaccagacggcagcgcgaattcgtgaaagacacaaccacccccaccatctcctgggcgcaaggcgcgaacccacaccacggcggcgacggcaccacaacaagagagaccggaagctacacagtcacaccgccgccaggccgccagcacaaacaagtcagcaccagtccgctcgagcgcggggcgccacccacagcgcacagctccccgcgccgcaaaaaaaccggccgagccgggaatactacagcagaacacatcccaccgggg

SEQ ID NO: 376081 - DNA, 423 bp, Homo sapiens
gcttcgaccttgttttcatgagggagagattggaacactcgcaggtgtacgaagtcctcgtcgccgacgtgcaccttgatgaagtagtttgtccccgcgaccacctggcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatcctta

SEQ ID NO: 376082 - DNA, 821 bp, Homo sapiens
  misc_feature (704)..(704): n is a, c, g, or t
  misc_feature (710)..(710): n is a, c, g, or t
cccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatccttaaaaaaaaaaaaagaaaacaaaaaaaaaacccgggggcctttattcgggggggggaaaanagggtntggaaagggcctgggcaaaaaagggtcggaacacaatatttggtaaaaggggagtattgcgggcccaataggggcgaataaaatgagaaagcgggtaacggtttagatgaa

SEQ ID NO: 376083 - DNA, 738 bp, Homo sapiens
tgacctcaagtgatccgcccacctcagcctcccaaagttctgggattacatccttgagccaccgtacccagctggaactgtttttttctactttattattaggctgacagtttaaatgtcccttcagttgtaagagacaattgtgtgaagagccagtgtcagaatcgtgtgtgtgctcacatgcgtgcaagttactctagcaggagggaatccaagaagccactgagacatcctcattctgtcccttctgtctaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatcctta

SEQ ID NO: 376084 - DNA, 767 bp, Homo sapiens
cccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatccttaaagaaaaaaaaaaaaaaacttggggggggggcgccgtccccaattcggccttatatggagtcgattaacaattcactggccgccgtttaacaacacatgactgggaaaaccctgcggtccct

SEQ ID NO: 376085 - DNA, 971 bp, Homo sapiens
cccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtagagtgtgggcctcaggagggcctgccccgaacgggtgctggtaggaaaccgcctgtgcaggcccgggctgtgtggtcttaggtgctggggcgccctgtggctgccccctgagataagcatcctactgtgtgtgtccatcggcctttcaggaggactagggcttctggggagctaagaaccccaaggaaacaagtgtgggatgtgaggcatcccctgcacatgcaggagaagacaagattgtcttcagctggctgctaatgacctggaggggcgcagcaaggtgacttgggatcagaggcttcgctcactccgctctcttcccagtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatcctta

SEQ ID NO: 376086 - DNA, 1064 bp, Homo sapiens
tgacctcaagtgatccgcccacctcagcctcccaaagttctgggattacatccttgagccaccgtacccagctggaactgtttttttctactttattattaggctgacagtttaaatgtcccttcagttgtaagagacaattgtgtgaagagccagtgtcagaatcgtgtgtgtgctcacatgcgtgcaagttactctagcaggagggaatccaagaagccactgagacatcctcattctgtcccttctgtctaggtgaggtcccagcttgaagagaaagaaaacaagaagttccctgtgtttaaggccgtgtcattcaagagccaggtggtcgcggggacaaactacttcatcaaggtagagtgtgggcctcaggagggcctgccccgaacgggtgctggtaggaaaccgcctgtgcaggcccgggctgtgtggtcttaggtgctggggcgccctgtggctgccccctgagataagcatcctactgtgtgtgtccatcggcctttcaggaggactagggcttctggggagctaagaaccccaaggaaacaagtgtgggatgtgaggcatcccctgcacatgcaggagaagacaagattgtcttcagctggctgctaatgacctggaggggcgcagcaaggtgacttgggatcagaggcttcgctcactccgctctcttcccagtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatcctta

SEQ ID NO: 376087 - DNA, 578 bp, Homo sapiens
cccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatcctta

SEQ ID NO: 376088 - DNA, 1168 bp, Homo sapiens
  misc_feature (986)..(986): n is a, c, g, or t
  misc_feature (993)..(993): n is a, c, g, or t
  misc_feature (996)..(996): n is a, c, g, or t
  misc_feature (998)..(998): n is a, c, g, or t
  misc_feature (1001)..(1001): n is a, c, g, or t
  misc_feature (1045)..(1045): n is a, c, g, or t
  misc_feature (1052)..(1052): n is a, c, g, or t
  misc_feature (1069)..(1069): n is a, c, g, or t
  misc_feature (1087)..(1088): n is a, c, g, or t
  misc_feature (1091)..(1091): n is a, c, g, or t
  misc_feature (1109)..(1109): n is a, c, g, or t
cccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtagagtgtgggcctcaggagggcctgccccgaacgggtgctggtaggaaaccgcctgtgcaggcccgggctgtgtggtcttaggtgctggggcgccctgtggctgccccctgagataagcatcctactgtgtgtgtccatcggcctttcaggaggactagggcttctggggagctaagaaccccaaggaaacaagtgtgggatgtgaggcatcccctgcacatgcaggagaagacaagattgtcttcagctggctgctaatgacctggaggggcgcagcaaggtgacttgggatcagaggcttcgctcactccgctctcttcccagtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatccttaaaaaaaaaaaaaaantaagccnggngnggnggtgcacaattgtagccccaaagtgctgggataacgggcttganccaccangccgggccgaaaagggntttttatgctatgtaaanngtntccattttcccccctttncatggtagaaaatcaccaaatactttaaaagtctgtagagtttatatgactcagctttt

SEQ ID NO: 376089 - DNA, 361 bp, Homo sapiens
gaaagaaatcaatacaatgaaatttaggaagagaaatgcaaaagcagcttcatagtcccccaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatcctta

SEQ ID NO: 376090 - DNA, 645 bp, Homo sapiens
cccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatcctta

SEQ ID NO: 376091 - DNA, 1380 bp, Homo sapiens
cccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatccttaacagattgcctcctttgttttagacttttttcttcgtctgaaccaccccgggcaggtccttcccctcgggggcatggagggcggagagactgcctggctcacacagcaagcaggtggtggacccaggattcacacctgcccactccggcccgcgttcctaaccaccactctttacatgttggtgctttgactcttaggtcctggccccaagcttcagtttctcccataaaataaaagagtgtgagtaaatccaattccagagcataactggctccagatctcagatacattcacgcactttatgctctggtacggagaggcagccacacagtgtcgtgcacgtgcagaatagcctgcagcctcactgagtgccctgtggtgcgggaggcttcccatggagccacgtgggcttctaaagggaggtatcttaggagagcgtggctgtttttaaaaacaccttctagttttcaacagggattacttcccattcatggaattggtccggtgccttcccaactgtgattctatgttaaataggacagaagagggagcatcatacatgataagagctaagactgggggtgaaagtctctgtgcaccggggtcatgatgtgaacgtgttcctgagggtgtcctgagctgcgctttgcctccgaggcgtccggcagcgtatgccagaactgcagctgcagggttcaggctgtccagatcgtgggggatctgtgaagactaagg

SEQ ID NO: 376092 - DNA, 856 bp, Homo sapiens
cccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatccttaaaaaaaaaaaaagaaaacaaaaaaaaaacctggggggctcaaggcgcgggggggggaaaagggggtaggaatggcgctggggcaaaggggtccgggacccagttttctgggtgccaaggggggaaatgggggggccccctattgggagcgaataattcgaaaagcggtaccgtagttttcccctcccaacagggtaacaaaatacaaaaga

SEQ ID NO: 376093 - DNA, 842 bp, Homo sapiens
  misc_feature (660)..(660): n is a, c, g, or t
  misc_feature (667)..(667): n is a, c, g, or t
  misc_feature (670)..(670): n is a, c, g, or t
  misc_feature (672)..(672): n is a, c, g, or t
  misc_feature (675)..(675): n is a, c, g, or t
  misc_feature (719)..(719): n is a, c, g, or t
  misc_feature (726)..(726): n is a, c, g, or t
  misc_feature (743)..(743): n is a, c, g, or t
  misc_feature (761)..(762): n is a, c, g, or t
  misc_feature (765)..(765): n is a, c, g, or t
  misc_feature (783)..(783): n is a, c, g, or t
cccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatccttaaaaaaaaaaaaaaantaagccnggngnggnggtgcacaattgtagccccaaagtgctgggataacgggcttganccaccangccgggccgaaaagggntttttatgctatgtaaanngtntccattttcccccctttncatggtagaaaatcaccaaatactttaaaagtctgtagagtttatatgactcagctttt

SEQ ID NO: 376094 - DNA, 812 bp, Homo sapiens
cccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtagagtgtgggcctcaggagggcctgccccgaacgggtgctggtaggaaaccgcctgtgcaggcccgggctgtgtggtcttaggtgctggggcgccctgtggctgccccctgagataagcatcctactgtgtgtgtccatcggcctttcaggaggactagggcttctggggagctaagaaccccaaggaaacaagtgtgggatgtgaggcatcccctgcacatgcaggagaagacaagattgtcttcagctggctgctaatgacctggaggggcgcagcaaggtgacttgggatcagaggcttcgctcactccgctctcttcccaaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatcctta

SEQ ID NO: 376095 - DNA, 3010 bp, Homo sapiens
gcgggcagcctcgagttcggattccacttctcagccttctggggtcactgaaaccctcagaactccgaggacaagtcggacacgccttcgcctcagccatcttcgccagcgcaataagtctctgtgtcttcacactcctggtagagggaaaactaaaacctccgggagccagcgtccggcggtgcctgcaatctaaccgggatttggggttccgagccacttttcccacaagccaccgcggtcatggagctttaggcttaaactacatttcccagagggcaacgggaacacccaatctatggcttcccttccgttttcgcgtggttcttttgcaagtttcaggaattagtgacattcagggatgtggccatagacttctctcggcaggagtgggaatacctggaccctaatcagagggacttatacagggatgtgatgttggagaactatagaaacctggtatcactggagatgaggtctcgctctgttgcccgggttggtctcaaactcctggtctcaagtgatcctcccacctcggccttccaaaatgctgggattataggcgtgagccaccatgcctagccaatagtagtattattatgtccagtttatttgccaaattggaataatgagttgaagtcacatggccaaagtcacaaggaggacattccatttctaaaccagttgtggttgatttactggagcgaggaaaagagccctggatgattttgagggaagaaacacagttcacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtgtgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaagaaaaaaaaaaaaaaaacaggaatcccagtttcttcatgcctacaacatccatggcatggatttttttttaaaaaaacttaataattaaggctgggcgcggtggtttgcctgtaatcccagcaccttgagaggccaaggtgggcggatcacgaggtcaggagatagagaccatcctggctaacacgatgaaaccccgtctctactaaaaatacaaaaaattagctgggcgtggtggcaggcgcctgcaatcccagctactcgggaggctgaggcaggagaatagcgtgaacccgggaggcagaccttgcagtgagcagagatcgcgccactgcactccagcctgggcaacagagtgagactccgt

SEQ ID NO: 376096 - DNA, 2764 bp, Homo sapiens
tattttatccattcctcagcaggtctgaattattgtggtaaccttcaacatgcagaaacatttgtctgtggcaataggatcctttaggaataggatcctttaggaataggatcctgtggcaataggatcctttaggaatatgtagacacgttgctttagtctgctaccagtcattagccacatatactatatcactccttttctctaatgtgctcttgtaatctcctatctttccttctttaaaatgtttttaaaattttgtaatgcatgggtttgcagtttttcaggaattagtgacattcagggatgtggccatagacttctctcggcaggagtgggaatacctggaccctaatcagagggacttatacagggatgtgatgttggagaactatagaaacctggtatcactgggaggacattccatttctaaaccagttgtggttgatttactggagcgaggaaaagagccctggatgattttgagggaagaaacacagttcacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtgtgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaagaaaaaaaaaaaaaaaacaggaatcccagtttcttcatgcctacaacatccatggcatggatttttttttaaaaaaacttaataattaaggctgggcgcggtggtttgcctgtaatcccagcaccttgagaggccaaggtgggcggatcacgaggtcaggagatagagaccatcctggctaacacgatgaaaccccgtctctactaaaaatacaaaaaattagctgggcgtggtggcaggcgcctgcaatcccagctactcgggaggctgaggcaggagaatagcgtgaacccgggaggcagaccttgcagtgagcagagatcgcgccactgcactccagcctgggcaacagagtgagactccgt

SEQ ID NO: 376097 - DNA, 1061 bp, Homo sapiens
gcgggcagcctcgagttcggattccacttctcagccttctggggtcactgaaaccctcagaactccgaggacaagtcggacacgccttcgcctcagccatcttcgccagcgcaataagtctctgtgtcttcacactcctggtagagggaaaactaaaacctccgggagccagcgtccggcggtgcctgcaatctaaccgggatttggggttccgagccacttttcccacaagccaccgcggtcatggagctttaggcttaaactacatttcccagagggcaacgggaacacccaatctatggcttcccttccgttttcgcgtggttcttttgcaagtttcaggaattagtgacattcagggatgtggccatagacttctctcggcaggagtgggaatacctggaccctaatcagagggacttatacagggatgtgatgttggagaactatagaaacctggtatcactggagatgaggtctcgctctgttgcccgggttggtctcaaactcctggtctcaagtgatcctcccacctcggccttccaaaatgctgggattataggcgtgagccaccatgcctagccaatagtagtattattatgtccagtttatttgccaaattggaataatgagttgaagtcacatggccaaagtcacaaggaggacattccatttctaaaccagttgtggttgatttactggagcgaggaaaagagccctggatgattttgagggaagaaacacagttcacagatttggatttacagtgtgagataatcagctacatagaagtacccacttatgaaacagatatatcctctacacaacttcagagcatatataagagagagaaactctatgaatagatgaagtctccctatgttgcctgagctggtctcaaactcttgatcctcctaccttgacctcccaaagtgctgggattatagcacgagcctgggccagttacacagttctgtaggtattattttgtacttttcacagtaaccacgtgcagccatgttgctttctgctgttgcataacaagatcccttccccctagt

SEQ ID NO: 376098 - DNA, 2910 bp, Homo sapiens
gcgggcagcctcgagttcggattccacttctcagccttctggggtcactgaaaccctcagaactccgaggacaagtcggacacgccttcgcctcagccatcttcgccagcgcaataagtctctgtgtcttcacactcctggtagagggaaaactaaaacctccgggagccagcgtccggcggtgcctgcaatctaaccgggatttggggttccgagccacttttcccacaagccaccgcggtcatggagctttaggcttaaactacatttcccagagggcaacgggaacacccaatctatggcttcccttccgttttcgcgtggttcttttgcaagctctggattctctggagtttgaatgtttccagtattggaaccccaccaagtaggactgatcaggtcttacaattctaaaaccatgacctgttttcaggaattagtgacattcagggatgtggccatagacttctctcggcaggagtgggaatacctggaccctaatcagagggacttatacagggatgtgatgttggagaactatagaaacctggtatcactgggaggacattccatttctaaaccagttgtggttgatttactggagcgaggaaaagagccctggatgattttgagggaagaaacacagttcacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtgtgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaagaaaaaaaaaaaaaaaacaggaatcccagtttcttcatgcctacaacatccatggcatggatttttttttaaaaaaacttaataattaaggctgggcgcggtggtttgcctgtaatcccagcaccttgagaggccaaggtgggcggatcacgaggtcaggagatagagaccatcctggctaacacgatgaaaccccgtctctactaaaaatacaaaaaattagctgggcgtggtggcaggcgcctgcaatcccagctactcgggaggctgaggcaggagaatagcgtgaacccgggaggcagaccttgcagtgagcagagatcgcgccactgcactccagcctgggcaacagagtgagactccgt

SEQ ID NO: 376099 - DNA, 2359 bp, Homo sapiens
ccaggctggagtgcagtggcttgatctcggctcactgcaacctctacctcccgcgttcaagtgattctcctgcctcagcctcccgagtagctgggattacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtgtgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaagaaaaaaaaaaaaaaaacaggaatcccagtttcttcatgcctacaacatccatggcatggatttttttttaaaaaaacttaataattaaggctgggcgcggtggtttgcctgtaatcccagcaccttgagaggccaaggtgggcggatcacgaggtcaggagatagagaccatcctggctaacacgatgaaaccccgtctctactaaaaatacaaaaaattagctgggcgtggtggcaggcgcctgcaatcccagctactcgggaggctgaggcaggagaatagcgtgaacccgggaggcagaccttgcagtgagcagagatcgcgccactgcactccagcctgggcaacagagtgagactccgt

SEQ ID NO: 376100 - DNA, 2381 bp, Homo sapiens
cacacctggctaatttttgtatttttagtagagatggggtttcaccatgttggccaggctggtctcgaactcctgacctcaggtgatccgcccacctcggcctccgaaagtgctgggattacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtgtgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtacgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaagaaaaaaaaaaaaaaaacaggaatcccagtttcttcatgcctacaacatccatggcatggatttttttttaaaaaaacttaataattaaggctgggcgcggtggtttgcctgtaatcccagcaccttgagaggccaaggtgggcggatcacgaggtcaggagatagagaccatcctggctaacacgatgaaaccccgtctctactaaaaatacaaaaaattagctgggcgtggtggcaggcgcctgcaatcccagctactcgggaggctgaggcaggagaatagcgtgaacccgggaggcagaccttgcagtgagcagagatcgcgccactgcactccagcctgggcaacagagtgagactccgt

SEQ ID NO: 376101 - DNA, 2124 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaacaaaaaaaacacaaaagggggggctaattcccgcagggccaagtaaggaaccgtttttgaagggcccaagaggataaaaagg

SEQ ID NO: 376102 - DNA, 1953 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376103 - DNA, 2121 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggtgagcggcccgggaggggccgggcggtggggtcacgtgcggcgggcggggcgcgggctgacccagctgtgcccgcaggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376104 - DNA, 2151 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgtgctgcccctgatcgcggaggtcgcgtcctgttcaccggcccgtctgccccgaccgcccaaggccgccttcccctgacctcgcgcgcacgcgtggggctggggcggcgaggctggcggtccggcctggccgcgactctgcccttctttccagaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376105 - DNA, 2367 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgtgctgcccctgatcgcggaggtcgcgtcctgttcaccggcccgtctgccccgaccgcccaaggccgccttcccctgacctcgcgcgcacgcgtggggctggggcggcgaggctggcggtccggcctggccgcgactctgcccttctttccaggtacgccttcgtcaggcccgtcatcctgcagggactcacggacaactcggtgagcgcgtgcccgtccgtccccggccactctcgcccgtgctgggcccggccactaagtcccctccccgcccccgcagaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatggtgaggcagccctaggcggcggtagggggtggggacgcttggagtctccaggtgccaggatccctgtccccgccgtctctgttggcagacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376106 - DNA, 2366 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggtgagcggcccgggaggggccgggcggtggggtcacgtgcggcgggcggggcgcgggctgacccagctgtgcccgcaggcgcccgggcgggccgggggccgtggcggaggaggagcgctgcacggtggagcgtcgggccgacctcacctacgcggagttcgtgcagcagtacgtgctgcccctgatcgcggaggtcgcgtcctgttcaccggcccgtctgccccgaccgcccaaggccgccttcccctgacctcgcgcgcacgcgtggggctggggcggcgaggctggcggtccggcctggccgcgactctgcccttctttccaggtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatggtgaggcagccctaggcggcggtagggggtggggacgcttggagtctccaggtgccaggatccctgtccccgccgtctctgttggcagacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376107 - DNA, 2123 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgagaggtcagtggctggcaggagagggccaggccaggctagaggcccgcagctaatctctgctgcacccccttcctccaccaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376108 - DNA, 2287 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcggtgagcgcgtgcccgtccgtccccggccactctcgcccgtgctgggcccggccactaagtcccctccccgcccccgcagaggttccgggccctgtgctcccgcgacaggttgctggcttcgtttggggacagagtggtccggctgagcaccgccaacacctactcctaccacaaaggtacgcggcctcacccctggggcccgcccatttgccaacaccggggcggctggaccagacggtcctgacccgtctctttcctgcagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaaggtcagcacggggtgggggttgaggcttgggactcgctgaccaaaacgggcaagggtgacactgctgctcatgcccccagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376109 - DNA, 2112 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggtacgccttcgtcaggcccgtcatcctgcagggactcacggacaactcggtgagcgcgtgcccgtccgtccccggccactctcgcccgtgctgggcccggccactaagtcccctccccgcccccgcagaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgagaggtcagtggctggcaggagagggccaggccaggctagaggcccgcagctaatctctgctgcacccccttcctccaccaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376110 - DNA, 2043 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376111 - DNA, 2071 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgctgcagaagctggcgcgggggtcgtggtggcgtgtgggggtggagtggggggg

SEQ ID NO: 376112 - DNA, 2278 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggtgagcggcccgggaggggccgggcggtggggtcacgtgcggcgggcggggcgcgggctgacccagctgtgcccgcaggcgcccgggcgggccgggggccgtggcggaggaggagcgctgcacggtggagcgtcgggccgacctcacctacgcggagttcgtgcagcagtacgtgctgcccctgatcgcggaggtcgcgtcctgttcaccggcccgtctgccccgaccgcccaaggccgccttcccctgacctcgcgcgcacgcgtggggctggggcggcgaggctggcggtccggcctggccgcgactctgcccttctttccaggtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376113 - DNA, 2122 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcggtgagcgcgtgcccgtccgtccccggccactctcgcccgtgctgggcccggccactaagtcccctccccgcccccgcagaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376114 - DNA, 2131 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatggtgaggcagccctaggcggcggtagggggtggggacgcttggagtctccaggtgccaggatccctgtccccgccgtctctgttggcagacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376115 - DNA, 2210 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcggtgagcgcgtgcccgtccgtccccggccactctcgcccgtgctgggcccggccactaagtcccctccccgcccccgcagaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatggtgaggcagccctaggcggcggtagggggtggggacgcttggagtctccaggtgccaggatccctgtccccgccgtctctgttggcagacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376116 - DNA, 1908 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaac

SEQ ID NO: 376117 - DNA, 1879 bp, Homo sapiens
aggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcagcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttggggggaagactacccccaagcgtccccttcctcccatggggagcaacaagaaccccaagacaccaacgggcggggggaattgcgttcccacaaccgggctccaacggggttgggcccaagaccaagaccaaaccacaacacaggggataacacaccccaa

SEQ ID NO: 376118 - DNA, 450 bp, Homo sapiens
gagacggagttttactcttttggcccaggctggagtgcaagggcgcaatctcggctcaccgaaacctccacctctcgggttcaagcgattctcctgcctcagcctcccgagtagctgggattaccggcatgcaccaccatgcccggctaatttcgtatttttagtagacagggtttctccacgttggtcaggctggtctccaactcccaacctcaggtgatccgcccgcctcagcctcccaaagtgctgggattacaggtgtgagccaccgtgcccagcctatctttttattaacctctaatacctaaaacctactacaattccgggagcatagcaatcgctagatctggtctggaagatctctgagtaactaactagctttttaataaaatgctttgttttgtaccatgtcgaggtaccaggacttgactttatgagcctcttatgaat

SEQ ID NO: 376119 - DNA, 301 bp, Homo sapiens
agctattgtttctacctcaccctggcccaggaagacagatctactgaggaaagccctgaacactctgcggcttctctgagaaaccctatcgaaggggatgtggaatcccagagctactcttgctatcaactcgccgcatgaccttgggaaaatcatttcacctggttcagcaatgatttactgagctattgaaggccttactttccagatccagtggcaggacatgaaggggacagagcgaaaaccctcagcccacatttactactagtaagccatgaaataaacaagtcctgaccatcct

SEQ ID NO: 376120 - DNA, 1257 bp, Homo sapiens
agctattgtttctacctcaccctggcccaggaagacagatctactgaggaaagccctgaacactctgcggcttctctgagaaaccctatcgaaggggatgtggaatcccagagctactcttgctatcaactcgccgcatgaccttgggaaaatcatttcacctggttcagcaatgatttactgagctattgaaggccttactttccagatccagatccttgtgcatacaactgacttgtgtgggtgaggcttgcagaaaaaatcagctagaacagccttgggggtagtggcaaggtggccagagcaattgactgggagctgggaacaggaatgaagaggaagagctgataagaaacatgcccagagcagattttgatggctactgccaatgttacctggaataagaagacaactctttctggaaaaagggaaaacttgaagggctattgaaggccgctagaaagtacagaaggaactttggatgtgggagagaaagacaaggagaaacctgaaagcagcccagttatgacaatgaatgttctggaggctgggaagtggaagagcattgtgccagcacctggtgagggccttcttgccgtgttacacatgatggtttttactgatgccctgcacagagagaggtctgtaaagtggcaagcaggagtctgctacaatggaggaaaggattttgctgtatctcttgccaggcccaaggctgcagagggaattgcagattgaatgtaagtgacttggaaaaggaagaggagttgccagaaacagctaaaatgtcagtagaagacttgacagcttgagaatagaggaaaaaataaaagcgaagcagacaaaaagaaccttacctcccccacaatacaacattgggctgctgaacccacaaaaatctaaatccgtttagaatcatctatttaactcctcagagacatgcacaaactattctagagaggcttgtgcctacgaagattacttaagaatgtgttgacacatttggagggggttaatttaccagttatcatttactagaaaggctttttctataagaatatatgaaagagtttcctcggagcattcaaccgggcttctttgtagggtatgtgtactgcttggagctacggaagaccacgtcctagaagtgctgtgtccctgaggcacacctatgtgtgttatctctctggcatactttccaacaaggattcttttctagtctatacattctgattaatttgcagtcagaggcaatgc

SEQ ID NO: 376121 - DNA, 503 bp, Homo sapiens
agctgcaccacctggtggatgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccacaagttcatccggaagttccactccatggcctccagagcagagatgccgcaggcccggcccttagaaggcgcattcagccccatctccttcaagccaggcctccaccaggctgacatcaagctgaccgtgtggaaaaggctcttccggaaagttttgccagccccggagcctctcaagttggaccctgccactgcccacccactcctggagctctccaagggcaacacggtggtgcagtgcgggcttctggcccagcggcgagccagccagcctgagcgcttcgactacagcacctgcgtcctggccagccgcggcttctcctgcggccgc

SEQ ID NO: 376122 - DNA, 548 bp, Homo sapiens
gaccattttccaaccaacactgctggtccccaaacctgcactctagaagcaccactatagagcgtttccccttctaggaaggagatgggtcctccctgaaggggctgtgcaggggaggggatgatgggcattgatgggcattgtgactgcagtcctgcactgtggatctggctgggcaaacatagataggatggaggggtggggtgggccacgtgatacctcactctcttgtactgtgaactgtcacctgcagagcagagatgccgcaggcccggcccttagaaggcgcattcagccccatctccttcaagccaggcctccaccaggctgacatcaagctgaccgtgtggaaaaggctcttccggaaagttttgccagccccggagcctctcaagttggaccctgccactgcccacccactcctggagctctccaagggcaacacggtggtgcagtgcgggcttctggcccagcggcgagccagccagcctgagcgcttcgactacagcacctgcgtcctggccagccgcggcttctcctgcggccgc

SEQ ID NO: 376123 - DNA, 407 bp, Homo sapiens
atcagtctgtgattgatcttccttatgtaaaacttcattcattcattcattcattcattcattcattcattcattcagggagcagccctgtactggccccttctagaccctggggctagagagatgaggaagacacagcccctctccttggggagttcagggcctccatcagcttctgtgggccgggtctgctgccctccacgtggcctcacagaccctctgtgatctccctcccagccccggagcctctcaagttggaccctgccactgcccacccactcctggagctctccaagggcaacacggtggtgcagtgcgggcttctggcccagcggcgagccagccagcctgagcgcttcgactacagcacctgcgtcctggccagccgcggcttctcctgcggccgc

SEQ ID NO: 376124 - DNA, 662 bp, Homo sapiens
agctgcaccacctggtggatgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccacaagttcatccggaagttccactccatggcctccagagcagagatgccgcaggcccggcccttagaaggcgcattcagccccatctccttcaagccaggcctccaccaggctgacatcaagctgaccgtgtggaaaaggctcttccggaaagttttgccagggagcagccctgtactggccccttctagaccctggggctagagagatgaggaagacacagcccctctccttggggagttcagggcctccatcagcttctgtgggccgggtctgctgccctccacgtggcctcacagaccctctgtgatctccctcccagccccggagcctctcaagttggaccctgccactgcccacccactcctggagctctccaagggcaacacggtggtgcagtgcgggcttctggcccagcggcgagccagccagcctgagcgcttcgactacagcacctgcgtcctggccagccgcggcttctcctgcggccgc

SEQ ID NO: 376125 - DNA, 494 bp, Homo sapiens
cacaccctggcatccacctttcctcctcttccaagataccagcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaatta

SEQ ID NO: 376126 - DNA, 468 bp, Homo sapiens
agaaaataggggccaaattgtcacatggtggcagcttttatgaatatggcatcagtgtggctttctttgagaattcaagacaagtgtgaatggaggctgtgcaagcaggagtctgtaacagaacctctcttccccagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaatta

SEQ ID NO: 376127 - DNA, 661 bp, Homo sapiens
ttgtaaagtgtatagaacttgataacaaaacttgatatgtaattaaacttgttaaattgtgaatcatcccagtcaaagataactaaaaaaaaatcagtcttctaatatcagtctctaagggtatagtcatatatgcaaaaataatagcccttaggaaatatatttaggcctaaatctctaagctaaggatggatttgatagtaaaaatacattaaaattataaatagctccaaggcccacacactgcccatgactttataaaatgttcttgcattcaggttatacagccagagtcttaattcagaaagccagagtgttcctctagtgtgtggatttgattttgtgtctttgtgcttcctgttgcctcctggtgaacgcagttctgacctttcctttgtttgcaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaatta

SEQ ID NO: 376128 - DNA, 2741 bp, Homo sapiens
acccggaagcggggccgtcacgtggggcggcgtgggctgctgccttggaaacgcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgccggggtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaagaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatcctcaaaattccgaagtaatgccctgggaccccccttactacagtggtgtgattcgtgcagaaaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggctgttgttcatgaatctgaaggattgttggggtacatttactgtgatttttttcagcgagcagacaaaccacatcaggattgccatttcactatccgtggaggcagactaaaggaagatggagactatcaactcccagttgtagttcttatgctgaatcttccccgttcctcaaggagttctccaactttgctaactcctggcatgatggaaaatcttttccatgaaatgggacatgccatgcattcaatgctaggacgtactcgttaccaacacgtcactgggaccaggtgccctactgattttgctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaattaaaaaaactaaaacacctcgttatgggtgatccagtctccctcgaagactcgtcgatgaattactgccaccccccaatcccgccgccgcccccccgcgaggagtcctgccgcatcttcccttgcggatgattaatatggaaccccccaactccccctcgtccccccactacttgtagggtgacgacgccgcaacccattcaaggaggccctcgggtaccccgaacccccgccgacccccaaacaacattcctccaaagaccctcccctgtacgcgccccccatttaccactttagcgaactcctaactcaccccg

SEQ ID NO: 376129 - DNA, 2349 bp, Homo sapiens
acccggaagcggggccgtcacgtggggcggcgtgggctgctgccttggaaacgcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgccggggtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaagaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatcctcaaaattccgaagtaatgccctgggaccccccttactacagtggtgtgattcgtgcagaaaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggctgttgttcatgaatctgaaggattgttggggtacatttactgtgatttttttcagcgagcagacaaaccacatcaggattgccatttcactatccgtggaggcagactaaaggaagatggagactatcaactcccagttgtagttcttatgctgaatcttccccgttcctcaaggagttctccaactttgctaactcctggcatgatggaaaatcttttccatgaaatgggacatgccatgcattcaatgctaggacgtactcgttaccaacacgtcactgggaccaggtgccctactgattttgctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaaacactctacacctcttaaataagttaaccgcagatatactttgcatatgaccgctggtgcgggggggggttgtgtt

SEQ ID NO: 376130 - DNA, 1592 bp, Homo sapiens
acccggaagcggggccgtcacgtggggcggcgtgggctgctgccttggaaacgcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgccggggtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaagaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatcctcaaaattccgaagtaatgccctgggaccccccttactacagtggtgtgattcgtgcagaaaggtataatattgagcccagcctatattgcccgtttttctctcttggagcatgcatggaaggcctgaatattttgcttaacagactgttggggatttcattatatgtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaatta

SEQ ID NO: 376131 - DNA, 460 bp, Homo sapiens
ctgggagctgcattgtggtgttttcaaattcaagggttataatttgcttgggcgtatatcacgacattccaggatttgaaggaaaaataatttgctcctaaaattgtccagccagcacttcttcccagctcttgtgggtggttagtaaaggtattgtagaggataggcagtcaggacaaaaggccctcatgaggaggatttcctgtcctggacacagaattccaaaaccaaaatcattcaagagatggagcagaagaggatgcggggaaaagagaatctatctcgagataatgtggggtgtagaatgtaattaaaatgtctatatgtgtggctatggatgtttaatatacagattcttgtgttagggattttagagaatcagatggcctcatttaccaccaaatttaaatttttttttctaggctgttgttcatgaatctgaaggattgttggggtacat

SEQ ID NO: 376132 - DNA, 2427 bp, Homo sapiens
acccggaagcggggccgtcacgtggggcggcgtgggctgctgccttggaaacgcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgccggggtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaagaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatcctcaaaattccgaagtaatgccctgggaccccccttactacagtggtgtgattcgtgcagaaaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggctgttgttcatgaatctgaaggattgttggggtacatttactgtgatttttttcagcgagcagacaaaccacatcaggattgccatttcactatccgtggaggcagactaaaggaagatggagactatcaactcccagttgtagttcttatgctgaatcttccccgttcctcaaggagttctccaactttgctaactcctggcatgatggaaaatcttttccatgaaatgggacatgccatgcattcaatgctaggacgtactcgttaccaacacgtcactgggaccaggtgccctactgattttgctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaatta

SEQ ID NO: 376133 - DNA, 2881 bp, Homo sapiens
acccggaagcggggccgtcacgtggggcggcgtgggctgctgccttggaaacgcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgccgggtgagcggcgcaggaggagctcccctcagtccccgagctaagccgacccctgctccgcgcggccagcaacaatcagggcgagattgtttgggcctgggaggaggcgagcagcgaacccaccttttacagtggcgtcttgtgtgcgctctcgatgagggcaaggtcacctctgctttgaggggccgggtttagtggtctcctacccagagtgtcgggtccgggaactgcttctgcatgagccccttgctccacgtgaatctgaatagttcgttctggcagtggcggtgaattcgtcctgccaggacccgccctctgcatacactcaggcgcacccctgctaaagccctttagctccagcgctacagtcctgccttaagaggcctatccctgtgcgttcacaggcggcatcacatggtctttttgcaaggacacggctgcctgcagtcgagtaatgggtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaagaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatcctcaaaattccgaagtaatgccctgggaccccccttactacagtggtgtgattcgtgcagaaaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggctgttgttcatgaatctgaaggattgttggggtacatttactgtgatttttttcagcgagcagacaaaccacatcaggattgccatttcactatccgtggaggcagactaaaggaagatggagactatcaactcccagttgtagttcttatgctgaatcttccccgttcctcaaggagttctccaactttgctaactcctggcatgatggaaaatcttttccatgaaatgggacatgccatgcattcaatgctaggacgtactcgttaccaacacgtcactgggaccaggtgccctactgattttgctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaatta

SEQ ID NO: 376134 - DNA, 1023 bp, Homo sapiens
aaacatttatacaataactatcacttcaatcatccaaaataaaattcaagaagagtcttagattgccatttcactatccgtggaggcagactaaaggaagatggagactatcaactcccagttgtagttcttatgctgaatcttccccgttcctcaaggagttctccaactttgctaactcctggcatgatggaaaatcttttccatgaaatgggacatgccatgcattcaatgctaggacgtactcgttaccaacacgtcactgggaccaggtgccctactgattttgctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaatta

SEQ ID NO: 376135 - DNA, 1800 bp, Homo sapiens
acccggaagcggggccgtcacgtggggcggcgtgggctgctgccttggaaacgcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgccggggtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaagaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatcctcaaaattccgaagtaatgccctgggaccccccttactacagtggtgtgattcgtgcagaaaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggctgttgttcatgaatctgaaggattgttggggtacatttactgtgatttttttcagcgagcagacaaaccacatcaggattgccatttcactatccgtggaggcagactaaaggaagatggagactatcaactcccagttgtagttcttatgctgaatcttccccgttcctcaaggagttctccaactttgctaactcctggcatgatggaaaatcttttccatgaaatgggacatgccatgcattcaatgctaggacgtactcgttaccaacacgtcactgggaccaggtgccctactgattttgctgaggttccttctattctgatggagtactttgcaaatgattatcgagtagttaaccaatttgccagacattatcagactggacaggtaggaacagtaatattgtcg

SEQ ID NO: 376136 - DNA, 888 bp, Homo sapiens
aggaagttctggaaggcagtggggtttgagattggacccagggtcaagatagaacatgaaggtgggatgaggacatgaacagaacatggccaagaaggatctgggggagcagccaggacgaggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctgggggtaaggggcaccctggcgtgggatctgaaccccctcccgatctcttccaaatgtccccgctctccccaggctctcccctcccgccacttgccagggctgacctcaccgccatcttaaccgggtgttcacctctctctgcctgcctggtgctggcccgcgtcccatcgccgcgcccgtctgctcccctcagagggcttgctgacgctgcgggccagccgccctcggaggcgagtacaccgacgtgctgcgaagatcaagtacgccttcagctctggccggtgaggacgcgcccgc

SEQ ID NO: 376137 - DNA, 959 bp, Homo sapiens
gagtcaagcacaccctagtcgagtcttgtctgtacctcccagacgagctgaccccttctccagaactctgcttcttttctctgttccctgtccaggccctcagtttcactctagagaggtgctatccctccgtatatcggatttctccctacctcgttgaacttgttcactccctttgagccttttgagcctgtgtgtctcgttctgcgccctggatttccccctccctggacccctcagtggacccagtcttggtgtccccgtcgccctccgcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctgggggtaaggggcaccctggcgtgggatctgaaccccctcccgatctcttccaaatgtccccgctctccccaggctctcccctcccgccacttgccagggctgacctcaccgccatcttaaccgggtgttcacctctctctgcctgcctggtgctggcccgcgtcccatcgccgcgcccgtctgctcccctcagagggcttgctgacgctgcgggccagccgccctcggaggcgagtacaccgacgtgctgcgaagatcaagtacgccttcagctctggccggtgaggacgcgcccgc

SEQ ID NO: 376138 - DNA, 959 bp, Homo sapiens
gagtcaagcacaccctagtcgagtcttgtctgtacctcccagacgagctgaccccttctccagaactctgcttcttttctctgttccctgtccaggccctcagtttcactctagagaggtgctatccctccgtatatcggatttctccctacctcgttgaacttgttcactccctttgagccttttgagcctgtgtgtctcgttctgcgccctggatttccccctccctggacccctcagtggacccagtcttggtgtccccgtcgccctccgcagaacaagcattcgcggacagaaagactcctgtagaaaaaaagcgtgttagcccctttgaggtttggggaatcatgtaaaggggacccagacctcacttttagttatttacaccaatgagttccttcagggaacccacccccaaaatgcgagcaaagcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctgggggtaaggggcaccctggcgtgggatctgaaccccctcccgatctcttccaaatgtccccgctctccccaggctctcccctcccgccacttgccagggctgacctcaccgccatcttaaccgggtgttcacctctctctgcctgcctggtgctggcccgcgtcccatcgccgcgcccgtctgctcccctcagagggcttgctgacgctgcgggccagccgccctcggaggcgagtacaccgacgtgctgcgaagatcaagtacgccttcagctctggccggtgaggacgcgcccgc

SEQ ID NO: 376139 - DNA, 1300 bp, Homo sapiens
taggattgacactggctgtcaaactcatccttcaaggtgattcctggcctgccctcctcctccaggcagcctgtcctcctcctccaggcagcctgtcctgaccctcagcagcctctcctggccttggcagagcccctcgtgtcctcccttgcagcacgcatgggaagaaaggccatcgtcctcgccattgctaacaccagccttgcgtttcctctttgccagcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctgggggtaaggggcaccctggcgtgggatctgaaccccctcccgatctcttccaaatgtccccgctctccccaggctctcccctcccgccacttgccagggctgacctcaccgccatcttaaccgggtgttcacctctctctgcctgcctggtgctggcccgcgtcccatcgccgcgcccgtctgctcccctcagagggcttgctgacgctgcgggccagccgccctcggaggcgagtacaccgacgtgctgcgaagatcaagtacgccttcagctctggccggtgaggacgcgcccgc

SEQ ID NO: 376140 - DNA, 1186 bp, Homo sapiens
tggaggaggtgtggttagtctcaggctgaaagtctgattattctgggggattctgagcccacctggcatcatcttgggcctcactgctttctccatggtccgtaccagcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctgggggtaaggggcaccctggcgtgggatctgaaccccctcccgatctcttccaaatgtccccgctctccccaggctctcccctcccgccacttgccagggctgacctcaccgccatcttaaccgggtgttcacctctctctgcctgcctggtgctggcccgcgtcccatcgccgcgcccgtctgctcccctcagagggcttgctgacgctgcgggccagccgccctcggaggcgagtacaccgacgtgctgcgaagatcaagtacgccttcagctctggccggtgaggacgcgcccgc

SEQ ID NO: 376141 - DNA, 1552 bp, Homo sapiens
ggaaaggacagcggagagcagggcagagctgagcaggcagggcacctccaggtgggcaggagctaccactcagcaccatgagcaccgccacaggcccagaagctgccccaaagccaagcgccaagtctatctatgagcagaggaagcgttactccacagttgttatggctgatgtatcccagtacccagtcaatcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggtgagccgctaaggaaggggtctgggggcagggccaggcgactggaggcggggctagggcgtggaagggcggggccggctgcgggacgggcgttctctggtcagacttctgcgttatggaagaggggctgggtcgggggcggggcttggttgtggggcgtggccaggtgtttggggcgtggcctgatctggggaagtgtataggtgctcaggttcagggcttcgacggggatggttttggaactcgggagccctgagcgtccccctcctctgtcccctaggacatcctgaaccacgtgttcgacgacgtagagagctttgtatcgaggctgcagaagtcggcggaggcggccagggtgctggagcaccgggaacgcggccgcaggagccggcgccgggcggctgggggtaaggggcaccctggcgtgggatctgaaccccctcccgatctcttccaaatgtccccgctctccccaggctctcccctcccgccacttgccagggctgacctcaccgccatcttaaccgggtgttcacctctctctgcctgcctggtgctggcccgcgtcccatcgccgcgcccgtctgctcccctcagagggcttgctgacgctgcgggccagccgccctcggaggcgagtacaccgacgtgctgcgaagatcaagtacgccttcagctctggccggtgaggacgcgcccgc

SEQ ID NO: 376142 - DNA, 1272 bp, Homo sapiens
ggaaaggacagcggagagcagggcagagctgagcaggcagggcacctccaggtgggcaggagctaccactcagcaccatgagcaccgccacaggcccagaagctgccccaaagccaagcgccaagtctatctatgagcagaggaagcgttactccacagttgttatggctgatgtatcccagtacccagtcaatcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctgggggtaaggggcaccctggcgtgggatctgaaccccctcccgatctcttccaaatgtccccgctctccccaggctctcccctcccgccacttgccagggctgacctcaccgccatcttaaccgggtgttcacctctctctgcctgcctggtgctggcccgcgtcccatcgccgcgcccgtctgctcccctcagagggcttgctgacgctgcgggccagccgccctcggaggcgagtacaccgacgtgctgcgaagatcaagtacgccttcagctctggccggtgaggacgcgcccgc

SEQ ID NO: 376143 - DNA, 676 bp, Homo sapiens
cacaaccaatgttttgtttcttcacagaacaggctatgagctattttcaattattgcactgaaatgctgtcctctaaaattaacaaatgaatgaagcatttgcaaactggacattgcactgagaacaacgtagagtgaaactatccagttgtttttctaattatattttatctacttagataataggaactagcaattactaatgttttttttttaactaagcaatttggtgggaaaaaacatcacctaaagtaatgtattattcttatgaacaatgtgaaacaaaattaatcatttggaatggcatctagatagtaggactttaattcttaatttagagtattgagcataaaatactatggttttattgaatcttttaccatgccatttcttacagtaaaaaaggaaaaatagaaatggaatatctagataattaaaataaacattttctggttatgtgaaacaaaggagagttttaaggggtagaagaggaaggtgcagaattcttatctgccttcctagcagacagagtaggcaagtggctacttgatccaatttcaaggacaactgcaaacagtgcatcctccccaaatatttccatcacccatttactgatgcattcaccatttttgtagtttaaaaatttgaacctcaataaaatccaaatgctactgag

SEQ ID NO: 376144 - DNA, 281 bp, Homo sapiens
gcgcctccaaggcaggcaggcaggcaggcacctccgtggaaaacccactcccgcctgctgacacctatgctcatccaacagatcatgccgactcaagatgcaggtcattctcttagagaaagtgggggcccaagccccagaaaataacccaaacatccagcggaaccgaccacccccaacatttcccgagggtggtaggtgtacctcgcgaagtgttcggggctgtccacgaggcacaactcttttatttctgcccaaggaagggcggcctgagtgcgtct

SEQ ID NO: 376145 - DNA, 1767 bp, Homo sapiens
gctttctaggcaagcgcaggtccaggcggtgcagcttgggcggcccagcggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctttcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaa

SEQ ID NO: 376146 - DNA, 357 bp, Homo sapiens
gagatggagtctcgctctgtcgcccaggctggagtgcagtggcgcaatctcagctcactgcaagctctgcctcccaggttcgcgccattcacctgcctcagcctctggagtagctgagactacaggcgcccaccaccatgcccggctaattttgtttgtatttttagtagagatggagtttcaccatgttggccagggtggtctcaatctcctgacctcgtgatccacccacctcgacctcccaaagtgctgagattacaggcgtgagccaccgcgcccagcgattgtttcttgaggcttccccagccatatggaactataagtcaattaaacctctttccttttataaatcaccca

SEQ ID NO: 376147 - DNA, 1797 bp, Homo sapiens
gctttctaggcaagcgcaggtccaggcggtgcagcttgggcggcccagcggatcgtgccgcggcggccgagcgcagctccttggaccgccccagtgacccctggagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctttcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaa

SEQ ID NO: 376148 - DNA, 2264 bp, Homo sapiens
gctttctaggcaagcgcaggtccaggcggtgcagcttgggcggcccagcggatcgtgccgcggcggccgagcgcaggcaggagatcatgtcctctgagatcttgagaaggtggctggagccctttggacctccgcgggaggcagtgataattagcctcctcctcccatcatgttctgaggatgggagagaggatggtgacggcaccggaggcctggggtgctctgcccggctgcgcattatatccccattaaagactggcctactgaaaaaggctggccctggaatcaaagaagatccgggcttcttccccctctgcccttatttttgaccttgggcagtgccttccacctctattgtgagaggccagagaaaaaaatcagagctcaccttttattaaagtacctgatgtgtcccaagctccttggaccgccccagtgacccctggagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattacacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctttcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaa

SEQ ID NO: 376149 - DNA, 2031 bp, Homo sapiens
gctttctaggcaagcgcaggtccaggcggtgcagcttgggcggcccagcggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattagtaagatccggggacttggggtaggggaaagcccaaatcaatttaccctggggtctctcccaccctggaaggggcagtcctagcccctcactgccctagtggtgagcccagcccctcgcacccctctgcctgcccccagcacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctttcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaa

SEQ ID NO: 376150 - DNA, 1268 bp, Homo sapiens
gctttctaggcaagcgcaggtccaggcggtgcagcttgggcggcccagcggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattacacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactgctttacggacattggatgaagccgaagcatttagaatggtgcctggcacacagttgtgagtgagttctcacgagatctgatggttttacaagtgacggtttccccggctccctcctgccgccatgtgaagaaggtcgttgcttccccttcaccttccaccaccatgatttagagatggagtttcaccatgttggccagggtggtctcaatctcctgacctcgtgatccacccacctcgacctcccaaagtgctgagattacaggcgtgagccaccgcgcccagcgattgtttcttgaggcttccccagccatatggaactataagtcaattaaacctctttccttttataaatcaccca

SEQ ID NO: 376151 - DNA, 1786 bp, Homo sapiens
tatattggacatcctttggcagcttgcagtttctttccattcctttgggctgaatgataatcctgtggagtagaccagcaggattttgctccattttatagatgaggaaactgaagcacagagaaaggaattggtccgtcccaaatcacagagttcaaactagaactccactgatttctagctggcaccaagaactcagccccttccttgttcccctgcccccctcaggcagtgccacactcagagtctgctcccaccctttttgttaaggctcatcttttatttcttttgttttttagagacacggtctcactctgttgcccaggctggagcgcagtgacgtgatcacagctcactgcagtcttgaactcctactttagcctgtactcctgcctcagcctgcctagaactacaggcacacaccaccatgcctggctaattttttttttcttgtagagatggtatctcactctctggtttgcgacaagactagttgcaaactcctgggctcaaacaaccctcccacctcagcctcccaaagtactgggattcccggtgtgagccgccacacccagcctgagtcagctcccttgacctttctcccccctctacctgccctgccaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctttcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaa

SEQ ID NO: 376152 - DNA, 351 bp, Homo sapiens
gtgattggattatgggagcggttttcccccatgctgttctcatgatagtgagtgagttctcacgagatctgatggttttacaagtgacggtttccccggctccctcctgccgccatgtgaagaaggtcgttgcttccccttcaccttccaccaccatgatttagagatggagtttcaccatgttggccagggtggtctcaatctcctgacctcgtgatccacccacctcgacctcccaaagtgctgagattacaggcgtgagccaccgcgcccagcgattgtttcttgaggcttccccagccatatggaactataagtcaattaaacctctttccttttataaatcaccca

SEQ ID NO: 376153 - DNA, 341 bp, Homo sapiens
tgccgagggaggcctggcaccgaccaggcccaggccgccgagcttgcccgggctgcgctgcgcggctgcgaacgggggctggggtcgccatcgatgtacaggggtccgagcccagactttggggggcattttaaggcacagcgtgggaaggggaggctgcaggcgcgctggcggacttggggctggcggagcccagccgcggggctgggggtgggagtgggggtggggagataggaagggcccttccctgtcgcccaccctcttgccactcccacctaggcaggagatcatgtcctctgagatcttgagaaggtggctggagccctttggacctccgcggg

SEQ ID NO: 376154 - DNA, 1997 bp, Homo sapiens
  misc_feature (1825)..(1825): n is a, c, g, or t
  misc_feature (1997)..(1997): n is a, c, g, or t
gctttctaggcaagcgcaggtccaggcggtgcagcttgggcggcccagcggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctttcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaaaaaaaaaaaaaaaaaaaaaaaaaaaaaaaaaaaaaaaaaaaaaaaaaaaaaaaaaaanaaaaaaaaaaaacaaaactattgcttgtgtttccgtttggattggctttgcgtatctactttcagtgctttcgtcatttccttcttcctagctgcttatcatgcgataggctacactgtgctcctttctcaattttacccagttctaatgggaatggtgtgtttagattttn

SEQ ID NO: 376155 - DNA, 2139 bp, Homo sapiens
gctttctaggcaagcgcaggtccaggcggtgcagcttgggcggcccagcggatcgtgccgcggcggccgagcgcaggcaggagatcatgtcctctgagatcttgagaaggtggctggagccctttggacctccgcgggaggcagtgataattagcctcctcctcccatcatgttctgaggatgggagagaggatggtgacggcaccggaggcctggggtgctctgcccggctgcgcattatatccccattaaagactggcctactgaaaaaggctggccctggaatcaaagaagatccgggcttcttccccctctgcccttatttttgaccttgggcagtgccttccacctctattgtgagaggccagagaaaaaaatcagagctcaccttttattaaagtacctgatgtgtcccaagctccttggaccgccccagtgacccctggagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctttcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaa

SEQ ID NO: 376156 - DNA, 1892 bp, Homo sapiens
gctttctaggcaagcgcaggtccaggcggtgcagcttgggcggcccagcggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattacacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctttcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaa

SEQ ID NO: 376157 - DNA, 1143 bp, Homo sapiens
gctttctaggcaagcgcaggtccaggcggtgcagcttgggcggcccagcggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactgctttacggacattggatgaagccgaagcatttagaatggtgcctggcacacagttgtgagtgagttctcacgagatctgatggttttacaagtgacggtttccccggctccctcctgccgccatgtgaagaaggtcgttgcttccccttcaccttccaccaccatgatttagagatggagtttcaccatgttggccagggtggtctcaatctcctgacctcgtgatccacccacctcgacctcccaaagtgctgagattacaggcgtgagccaccgcgcccagcgattgtttcttgaggcttccccagccatatggaactataagtcaattaaacctctttccttttataaatcaccca

SEQ ID NO: 376158 - DNA, 2403 bp, Homo sapiens
gctttctaggcaagcgcaggtccaggcggtgcagcttgggcggcccagcggatcgtgccgcggcggccgagcgcaggcaggagatcatgtcctctgagatcttgagaaggtggctggagccctttggacctccgcgggaggcagtgataattagcctcctcctcccatcatgttctgaggatgggagagaggatggtgacggcaccggaggcctggggtgctctgcccggctgcgcattatatccccattaaagactggcctactgaaaaaggctggccctggaatcaaagaagatccgggcttcttccccctctgcccttatttttgaccttgggcagtgccttccacctctattgtgagaggccagagaaaaaaatcagagctcaccttttattaaagtacctgatgtgtcccaagctccttggaccgccccagtgacccctggagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattagtaagatccggggacttggggtaggggaaagcccaaatcaatttaccctggggtctctcccaccctggaaggggcagtcctagcccctcactgccctagtggtgagcccagcccctcgcacccctctgcctgcccccagcacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctttcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaa

SEQ ID NO: 376159 - DNA, 2022 bp, Homo sapiens
ggctggtacggtctgggatgtatgggatcttgggcggccagcggatcgtgccgcggcggccgagcgcctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattagtaagatccggggacttggggtaggggaaagcccaaatcaatttaccctggggtctctcccaccctggaaggggcagtcctagcccctcactgccctagtggtgagcccagcccctcgcacccctctgcctgcccccagcacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcagcctcttctttgtggagcctctcagtgtgggcagccctcgcatgctggggtcgggccagctctccccgaaaggtcttgacctgaatgatggccggggaagcctgcgtgtgcccctttcagagacggagcacctgagatgtgggaggtgcagcatgttcccctgggcccctcagaaagtcgagcttggaggccagcctggatctgtctctcccttcccctcctgggaccattctacctgtgttctttgaccctcggagcagggacaggcaagacaactggcaagcttgcagctgccctgatggtgcaggtgcagggaggtgaccatgtaactctgaccaatctgggaagtggagggtgggctcatgggccgtgctctgcccctgtctgctgctcccagtctttcgctctgcctgcctgctcagaagaggtggctttggcccagaggctcaggccgggactgagatggacagacccagggtggggtggggtccaggtcgggtgtggactgtcctcactgtcagtggagccccagaagctagatgggtaccaggtggggttaggttcccagaggactgagggaatcctgtacaggatgtcccagggtagatggggagcaggattgggacctgctctgacagctggacacatgagccctggatgagtatggtagggggtttgaagaatcccctgtccacctcccaaatccaggcccggccccctctggcttggagagcattccaagcccccaccccacccctagaactgccattcccaagacctctgtctcccagccaaccacccttggaacttgcctcttgtcctgctggaaagatagcagtgttctcctgacttcgccctactgcatgcagccaaataaaaggtgtgcccagtctaa

SEQ ID NO: 376160 - DNA, 1158 bp, Homo sapiens
gctttctaggcaagcgcaggtccaggcggtgcagcttgggcggcccagcggatcgtgccgcggcggccgagcgcaggcaggagatcatgtcctctgagatcttgagaaggtggctggagccctttggacctccgcgggaggcagtgataattagcctcctcctcccatcatgttctgaggatgggagagaggatggtgacggcaccggaggcctggggtgctctgcccggctgcgcattatatccccattaaagactggcctactgaaaaaggctggccctggaatcaaagaagatccgggcttcttccccctctgcccttatttttgaccttgggcagtgccttccacctctattgtgagaggccagagaaaaaaatcagagctcaccttttattaaagtacctgatgtgtcccaagctccttggaccgccccagtgacccctggagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattacacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggagtctcccaaattctccaactaccgcccgcgtccgtagcagccgggccgagctcgatg

SEQ ID NO: 376161 - DNA, 340 bp, Homo sapiens
tctttgggagtaaagaatgagagtgaggtgggagcagtaattcatataagtcgagcttgcttgaatttggaaaattctttccttctttaggttttaaagtgacagaagtggtaatgaggttttttttgtttttcttttttaaaaagaaagcttattttgcagttaaggtcatttgacttgccttttgaaatgaatgcactcccatatgatattgatatatttaagctcagaacagtgagatattagatttaattaaaagaatctacattgcttatgtaagccttataagccttaaagtttgcttttttttttttttttttaaagatacagggtctcactt

SEQ ID NO: 376162 - DNA, 375 bp, Homo sapiens
agacttataaaagaagtagaacacacatgcttcccattaggtgagaaagaaacatgcctgagagtctaatggattactcaagtctgtgctgccaaggaagaacagaatctttagatatcatgtgttttacaaattgaagtttgtggaaaccctgcatcaaacaagtctattggtgacattttcccaacagcatttgctcactttgtgtttctgtgtcacatgttgataattcttacaatatttgaaaccttttttattattatacatgttctggtgatctgtgatcagtgatctttgatgttactactgtaatttttttggatgctgtgaactgtgcccatataaaatggtgaattaaatcaataaatgttgtgt

SEQ ID NO: 376163 - DNA, 1873 bp, Homo sapiens
agtccaaactcaagaggcagcatggagcgtggtctgcttccccactactcacggctctgcaatgtgggcaccaaggggccaacccttgcctttgccggaaaccctggagaacggtgacgtgaaatccacctgttttcctcatccccaagcaaacagaaccctgctgtaagttaatgaaaagtatagaaaaaccctgctgtaagttatgagaagtatagaaaaccatgctgtaagttaatgaaaagtatggaaaacagtctacttcggccaggcatggtggctcacacctgtaatcccagcacttagggaggtgaggtgcgtggattccttgagcccaggaattcgagaccagcctgggcgacaggacgagactagtctctacaaaaaatgtgaaaattagccgagtgtggtggcgtgcacctgtagtcccagctactcaggaggctgaggtgggaggatcgcttgagcctgagaggtcgaggctgcagtgagctgtgatcgtgccactgcactccagcctgggcaacagagcgagaccctgtttcaaaaaaaaaaaaacaaagcagtctgctttgtgcagtgttttcagtaataatccaactgtgaaaacccaactgtgaagacttagggagagagagctgctcccttagcgggtactcagcaggcagccggggagtggtgggcacctgagagctcctgatggtacccaggcagacttcggagaaggaagcgcggggccctgctgcctgggatcccagcagtggagccggctttttggagcaggaggcactgagggggtgttcaggctttccccccatgtttccccattcagggaaggggttgtacaaaagaggaacgcactgtccagtaacgctgcggcgccgtgggcagctctgagcgtggcggtgattggcagcaagtgtgtgagacttggctgtgaaccctgcagccagctctcaggtcagggtgcaggtgccctcagcacactcagcatcccaggaaaggggcggcctcgccccacctccctcccacggccacataccacaggtcccaggggtgcctccggtattgaggctgccttgcctccctttgtccgcactgtccctgtccccttgtgccacctgtgcagacttgagaatggagctcactgtggtgttcatgccggggcctgtctagctcctcaccccacgatttgaccagtgccacaccacgggaccttgtgtgacctcgggcctgcgtcctctggaaaacagctgtggagtggtgtgatgaggacaggtgccttggaaagcatcaggaccttgtgagcacgaggcagctgccagcactccacgttcccgccatgctctcctcaccgtgtgggcatccacctggccagcgccgcctccgcagtgcccctccctctggtcgctcccgcgcagcatgcgaaggtgttatctgcccgcgtcctgccttttccccacaccggcacggaggagccacgtgttcggtggtcgttcggacgtggtgatttgcaggtgacatcgcaggtgttgagatgacactgaggatgttgaatattggggaggtgaagcaactgactctttttttgcttgagacagggtctcacttcgttgcctaggctggagtgcagtgagctgagattgcaccactgccctccagactgggtgacagagtgagatttgtctcaaaaataaaaaaaggaaaaaaaaaaaacaaggacagtgtggatctgcatcaggattgaggctttcgctgaagggcttgcgttggtgacggattgtagtcttgaggcctgcagtcacaggacacttcccagcagatgtgtgaggctgacagagtgattttgtaaaccgaaagcctgttgtacgga

SEQ ID NO: 376164 - DNA, 520 bp, Homo sapiens
ctgtgtttgtgcctttgagcaggactgaacaggactgaaaaccttcctgtggaaacattagttaggagcgtgcctcaccctcacccctgcagggcctcttatggtctctgtagctgaacacacccctgctgcccagcacgcacccgcagaaggggtgtgcaccctagctgcaccgtccttccacacccctgctgcccagcatgcacccgcagaaggggtgtgcaccccagctccactgtccttcctcacgcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctca

SEQ ID NO: 376165 - DNA, 573 bp, Homo sapiens
acatggtggaaagtaagtgatgcagagtcagaggcagttcctggaagatgcactcgctgttcccaaaacgccaagccacacccactcctttagggatggtagacattggggtctcggttttattggtcatcctgagaaggccactggagtaatagaaagaaatggaatttgaagttgaaaagtgtagatctgccagcctgggcaacacggcaagaccccacctttacaaaaaatttaaaaattagccaggaatggtggcacgtgccagtggtcccagctccgagggagactaaggatacaggatcgcttgagcctgggtgctcaaggctgcagtgagctgagattgcaccactgccctccagactgggtgacagagtgagatttgtctcaaaaataaaaaaaggaaaaaaaaaaaacaaggacagtgtggatctgcatcaggattgaggctttcgctgaagggcttgcgttggtgacggattgtagtcttgaggcctgcagtcacaggacacttcccagcagatgtgtgaggctgacagagtgattttgtaaaccgaaagcctgttgtacgga

SEQ ID NO: 376166 - DNA, 1025 bp, Homo sapiens
ccaggctccggccccgcctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggtgagcactgcccttggtgtagcgctgtgcagggtgagcactgttcctgggtcagggtggtgcagggtgagcccacccctgggtcagggtgcagggtgagcgccgttcctgggtcagggtggtacagggtgagcaccattcctgggtgagggtgcagggtgagcccacccctgggtcagggtgcaggatgaacactgttcctggatcaggatggtgcagggtgaacccacccctcagtccatgtgcaggatgagcgtcgtccctgggtcagggtgcatgatgagcaccgcccctgggtcagggtgcagggtgagcgccacctctggtgcagggggcagggtgagcgccacctctggtgcagggtgcagggtgagcgccacctctggtgcagggtgcagggtgagcgccacctctggtgcagggctgtgcggggtgcagggtgagcgccaccccggggtcaggatggtgcagggtgagcactgccc

SEQ ID NO: 376167 - DNA, 3267 bp, Homo sapiens
ccaggctccggccccgcctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggtgagcactgcccttggtgtagcgctgtgcagggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctattgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgttcgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctca

SEQ ID NO: 376168 - DNA, 3917 bp, Homo sapiens
agtccaaactcaagaggcagcatggagcgtggtctgcttccccactactcacggctctgcaatgtgggcaccaaggggccaacccttgcctttgccggaaaccctggagaacggtgacgtgaaatccacctgttttcctcatccccaagcaaacagaaccctgctgtaagttaatgaaaagtatagaaaaaccctgctgtaagttatgagaagtatagaaaaccatgctgtaagttaatgaaaagtatggaaaacagtctacttcggccaggcatggtggctcacacctgtaatcccagcacttagggaggtgaggtgcgtggattccttgagcccaggaattcgagaccagcctgggcgacaggacgagactagtctctacaaaaaatgtgaaaattagccgagtgtggtggcgtgcacctgtagtcccagctactcaggaggctgaggtgggaggatcgcttgagcctgagaggtcgaggctgcagtgagctgtgatcgtgccactgcactccagcctgggcaacagagcgagaccctgtttcaaaaaaaaaaaaacaaagcagtctgctttgtgcagtgttttcagtaataatccaactgtgaaaacccaactgtgaagacttagggagagagagctgctcccttagcgggtactcagcaggcagccggggagtggtgggcacctgagagctcctgatggtacccaggcagacttcggagaaggaagcgcggggccctgctgcctgggatcccagcagtggagccggctttttggagcaggaggcactgagggggtgttcaggctttccccccatgtttccccattcagggaaggggttgtacaaaagaggaacgcactgtccagtaacgctgcggcgccgtgggcagctctgagcgtggcggtgattggcagcaagtgtgtgagacttggctgtgaaccctgcagccagctctcaggtcagggtgcaggtgccctcagcacactcagcatcccaggaaaggggcggcctcgccccacctccctcccacggccacataccacaggtcccaggggtgcctccggtattgaggctgccttgcctccctttgtccgcactgtccctgtccccttgtgccacctgtgcagacttgagaatggagctcactgtggtgttcatgccggggcctgtctagctcctcaccccacgatttgaccagtgccacaccacgggaccttgtgtgacctcgggcctgcgtcctctggaaaacagctgtggagtggtgtgatgaggacaggtgccttggaaagcatcaggaccttgtgagcacgaggcagctgccagcactccacgttcccgccatgctctcctcaccgtgtgggcatccacctggccagcgccgcctccgcagtgcccctccctctggtcgctcccgcgcagcatgcgaaggtgttatctgcccgcgtcctgccttttccccacaccggcacggaggagccacgtgttcggtggtcgttcggacgtggtgatttgcagggtctcacttcgttgcctaggctggagtgcagtggcacaatctcagctcactgcagcctcgacctcccaagctcagtagagacggggattcgccgtgttgcccaggctggtcttgaactcctggagtcaagcgatctgtccaccttggcctcctaaagtgatgggattacaggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctattgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgttcgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctca

SEQ ID NO: 376169 - DNA, 3016 bp, Homo sapiens
ccaggctccggccccgcctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctattgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgttcgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcgcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctca

SEQ ID NO: 376170 - DNA, 3124 bp, Homo sapiens
ccaggctccggccccgcctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctattgcaagcacgtggagcggcagctctgcagcgtctggatcagcaacaaaaccgccaagcagcactcgctgcactccgcccagtggtgcgttcttcctctgcccccgcatgccctcctgaagcagcgctcgctgcactctgcccagtggtgcagcgccccccttgtgccctcctggtagacagctttctaggcttctggaagtgtcatctggaagcgcacgttggtggctttagatccataatgcttcattgcttcattttcctgtcttggggctgcacggcgctgccgtccaccccacaggggatgctggctctgtccctcagccctttctggagccttgtggtgactgcacgggcatggagactgcccaggtcggtgtgcaggacactagctcctcccgagagcggacagccacatcttgctgggaccagaggtgctttgcagccggtctgtgcctctagggtgttgaaaaaaggggtcgatggcagagcttcataagaatttgtccagtcgggtgcagtggctcatgcctgtaatctcagcactttgggaagctgaggagggaggattgtttgagcccacaagttcgagacccgcctggacaatgtaacaagagctcatctcttaaaaaaaaagaaaattattttaattagccgggaatgcctgtagttccagcaactcaggaggctgaggtgggagggttgcttgagtccaggaggtcaaggctgcagtgagccaagatcgtgccactgcactgcagtctgagcgacagcaagaccctgtctctcgaagaa

SEQ ID NO: 376171 - DNA, 1763 bp, Homo sapiens
tctagtcaggcgcggttgatcggacgagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctattgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgttcgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctca

SEQ ID NO: 376172 - DNA, 2383 bp, Homo sapiens
ccaggctccggccccgcctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaaagcctcaatcggtaccagaagtcttcgggggcctgtgctatggaagcccgtgggcggcggcctggcggctgggtagacaaaacgccaagagaccgcgcccgcccaaggggggggggggacaccgcgg

SEQ ID NO: 376173 - DNA, 308 bp, Homo sapiens
gcgctgttgtgggggaggggttaggtcccatcctgatgaccatggggacgtctgcatcgcttctaaagagagcgcccgccttggtgacaactccgtgcccaactcagttttggagggtctgtgagtcaccatccagggtcctgactcatctcctcctggggcaaaagttcccctctgggatgtggggttcaagtgagtcatttgcttcctgtttgggatgagactcagaatatcggacattgtatgtgcctgcagcttgcctttttgaggaagtctgacagccaggttcattgaagagaagtcttcct

SEQ ID NO: 376174 - DNA, 3234 bp, Homo sapiens
ccaggctccggccccgcctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctattgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgttcgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctca

SEQ ID NO: 376175 - DNA, 780 bp, Homo sapiens
  misc_feature (16)..(16): n is a, c, g, or t
  misc_feature (41)..(41): n is a, c, g, or t
  misc_feature (49)..(49): n is a, c, g, or t
gctaggtacgagcctngggttactcggacgagggagagagngagagagnactagcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctca

SEQ ID NO: 376176 - DNA, 289 bp, Homo sapiens
gggccgtggtgtcaacgcaccgtgttgggcacgcaccgtgttgggccaacgttggccaacgcaacttctcagcccacctgctggacctcctggcccggctgagcatctatagcaccagtgactgtgagcacggcatggccagcgtcatctccagaggtgggtgggcgccaccccggctcagcccttcctcagctcagtccagcgcctgcccctgcccagcaccgccctggctcagcccttcctcagctcagtccagcacctgcccctgcccaacaccgccctggcccag

SEQ ID NO: 376177 - DNA, 4001 bp, Homo sapiens
agtccaaactcaagaggcagcatggagcgtggtctgcttccccactactcacggctctgcaatgtgggcaccaaggggccaacccttgcctttgccggaaaccctggagaacggtgacgtgaaatccacctgttttcctcatccccaagcaaacagaaccctgctgtaagttaatgaaaagtatagaaaaaccctgctgtaagttatgagaagtatagaaaaccatgctgtaagttaatgaaaagtatggaaaacagtctacttcggccaggcatggtggctcacacctgtaatcccagcacttagggaggtgaggtgcgtggattccttgagcccaggaattcgagaccagcctgggcgacaggacgagactagtctctacaaaaaatgtgaaaattagccgagtgtggtggcgtgcacctgtagtcccagctactcaggaggctgaggtgggaggatcgcttgagcctgagaggtcgaggctgcagtgagctgtgatcgtgccactgcactccagcctgggcaacagagcgagaccctgtttcaaaaaaaaaaaaacaaagcagtctgctttgtgcagtgttttcagtaataatccaactgtgaaaacccaactgtgaagacttagggagagagagctgctcccttagcgggtactcagcaggcagccggggagtggtgggcacctgagagctcctgatggtacccaggcagacttcggagaaggaagcgcggggccctgctgcctgggatcccagcagtggagccggctttttggagcaggaggcactgagggggtgttcaggctttccccccatgtttccccattcagggaaggggttgtacaaaagaggaacgcactgtccagtaacgctgcggcgccgtgggcagctctgagcgtggcggtgattggcagcaagtgtgtgagacttggctgtgaaccctgcagccagctctcaggtcagggtgcaggtgccctcagcacactcagcatcccaggaaaggggcggcctcgccccacctccctcccacggccacataccacaggtcccaggggtgcctccggtattgaggctgccttgcctccctttgtccgcactgtccctgtccccttgtgccacctgtgcagacttgagaatggagctcactgtggtgttcatgccggggcctgtctagctcctcaccccacgatttgaccagtgccacaccacgggaccttgtgtgacctcgggcctgcgtcctctggaaaacagctgtggagtggtgtgatgaggacaggtgccttggaaagcatcaggaccttgtgagcacgaggcagctgccagcactccacgttcccgccatgctctcctcaccgtgtgggcatccacctggccagcgccgcctccgcagtgcccctccctctggtcgctcccgcgcagcatgcgaaggtgttatctgcccgcgtcctgccttttccccacaccggcacggaggagccacgtgttcggtggtcgttcggacgtggtgatttgcaggtgacatcgcaggtgttgagatgacactgaggatgttgaatattggggaggtgaagcaactgactctttttttgcttgagacagggtctcacttcgttgcctaggctggagtgcagtggcacaatctcagctcactgcagcctcgacctcccaagctcagtagagacggggattcgccgtgttgcccaggctggtcttgaactcctggagtcaagcgatctgtccaccttggcctcctaaagtgatgggattacaggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctattgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgttcgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctca

SEQ ID NO: 376178 - DNA, 2722 bp, Homo sapiens
ggcccgtggccgtcctcgtgaggaagcttagctgtgtgtcctgcagccgtctcatcctctctggatagaaattatcaagagtttcttaacgtttaagtgatagctttttaaagacaaggttttttgtcccagagtaactcagacttaccaagttgtacttaccaatgttgaaagtgcagcttctgctggagtcgccttttcaactcctaacttcaccttttcaaatgtcagccatgtatctgagcattgcggagccgagtgtggtgagatcttgacaccagccaccacgcctcccaggccggccccgtcctgcggcggttggaactcagcctgtggctccccagtggggtcagtcaaagccaagtgcagtggctgaccttttatacccataaacaaatatgagcaagagtgagactgacccgcagatgagggcacgtggctgtgggggcatgggagtgggggctgcggagccacagcgctgtctgtgcccgcaggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctattgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgttcgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctca

SEQ ID NO: 376179 - DNA, 3203 bp, Homo sapiens
ccaggctccggccccgcctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctattgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgttcgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctca

SEQ ID NO: 376180 - DNA, 3014 bp, Homo sapiens
ccaggctccggccccgcctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctattgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgttcgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccagatcctaggctcgacgtcaatggtattaagtcctgctgggattcctggatta

SEQ ID NO: 376181 - DNA, 2702 bp, Homo sapiens
ccaggctccggccccgcctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctattgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgttcgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgttctgtgttctgtctttgcagtttaaatataaagcaggaatgattgactcagctca

SEQ ID NO: 376182 - DNA, 2478 bp, Homo sapiens
ccaggctccggccccgcctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggtgcgggtcggctgctcgggcacctgccagatcttcactcaggtttggcagaagcgagaactgtgccacgcggtggccacctcgtcccacagaggacccaaggcggctctccccagccttcagtgtccgggagattcacgggctgtccgggggccacggtgcggactgtggagtacagacgccgtgtccacga

SEQ ID NO: 376183 - DNA, 1621 bp, Homo sapiens
cagagtccaaacagggccctccctaatcctattatctttcaatggttaccttgacttaacctattgagttacctggtcagcactgggatctttttttctctccaaaggacctgcgttggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctattgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgttcgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccagaattttcaaatcgaatgctctgtgttctgtctttgcagtttaaatataaagcaggaatgattgactcagctca

SEQ ID NO: 376184 - DNA, 406 bp, Homo sapiens
aaaaattggtatatagtttagtatgacttctgaataagagaaagctgacccttataatttaaatgaattatttagcttagtattattcctgcattttaacaatggctatttaatctttcttaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtatgtgtgaccacagtttttgatgtaatgcttagctaaaatcaacactttatttatttatttttttggagacagagtcttgctctgtcgcccagacgggaattgcgccagtgcacttcagcctgagcaacagagcaaggctgtatc

SEQ ID NO: 376185 - DNA, 2971 bp, Homo sapiens
tgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcaacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataaggttgcatgaacaagatttaaacaagagacttgaaaaagagttggatgtcatgacagcagaccacctcagagagaaaaatatcatgcgggcagattttaataagactaacgagctactcaaggaaataaatgccgctttacaagtgtcattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaagcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaaaaaaaaaat

SEQ ID NO: 376186 - DNA, 3066 bp, Homo sapiens
tgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcaacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataaggttgcatgaacaagatttaaacaagagacttgaaaaagagttggatgtcatgacagcagaccacctcagagagaaaaatatcatgcgggcagattttaataagactaacgagctactcaaggaaataaatgccgctttacaagtgtcattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaagcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgaggtatcagtaagatgcatgtgcatgagctcaaggaacatgactactggagtttccattacacattgttgcgtgccttgtaattttccccaaagacgtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaaaaaaaaaat

SEQ ID NO: 376187 - DNA, 1512 bp, Homo sapiens
atatgcttattgtcaaaatagaaacatacgtaaactctgggaacttaaatatacttatgcaaaaactaaatttagaaaaaataaataattttaaaaatttccattccaattttttaccttgcagttgttgattaaatgtattagcaaattttgaatgaaatgcaaatttcattagaaatttagccattagataaagtcagaaagtactgttgttttatgctcatcttactattactgattttttgctgctttatgttttttttcttattcttactaaatcttagcagtgtcactagtaatagtcttacaaagtaggcaggtttttttaggctaagtgattagtgacatagttaatgattaacaaaaaaaatagcaagaatgaaaattagtcagatacacctctgaatttgtctcctgctaaatattttgtgttgcttattttcccttgtgcatgggtatgttcaggtatcagtaagatgcatgtgcatgagctcaaggaacatgactactggagtttccattacacattgttgcgtgccttgtaattttccccaaagacggtagggattcttttgttttcttaagtagcccaaagaatctttagttagaattaagaaaagtataaactatataacatctaacgggggaaattatatttttagtgttctccctttcctgggagtatttgcatagggaattatgaaatgaaaatttaatgtaaaatgcatatagtaaaaaatactagtagttactttagttatatttaaggacacatctgtacgatcagctaaaagagaaaaggtgctgaaagagaggacccattattttattctctcgtttcccaccaattcttactggaattttttattcaaaggagggtgacatttttgccagttgttttttgttctttgtgattgttgtgatgtggctcctccttaactgacttcatttgagctgctgatgcactcttatgctctcatggagtggagaaccgattctagtatagagggggtagcaaatctttaaaacacgacttacaacatggggaacccgttgtggtaatctatgctgatgttttatgtgcttttgccttcattttgcaaaatgacttaatgctgggttacatgtctctctttttatgaattcagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaaaaaaaaaat

SEQ ID NO: 376188 - DNA, 2863 bp, Homo sapiens
tgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcaacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataaggttgcatgaacaagatttaaacaagagacttgaaaaagagttggatgtcatgacagcagaccacctcagagagaaaaatatcatgcgggcagattttaataagactaacgagctactcaaggaaataaatgccgctttacaagtgtcattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaaggtatcagtaagatgcatgtgcatgagctcaaggaacatgactactggagtttccattacacattgttgcgtgccttgtaattttccccaaagacgtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaaaaaaaaaat

SEQ ID NO: 376189 - DNA, 2803 bp, Homo sapiens
tgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcaacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataaggttgcatgaacaagatttaaacaagagacttgaaaaagagttggatgtcatgacagcagaccacctcagagagaaaaatatcatgcgggcagattttaataagactaacgagctactcaaggaaataaatgccgctttacaagtgtcattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaagcaaaagaagaagaatgataaatcaccaacaaacagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaaaaaaaaaat

SEQ ID NO: 376190 - DNA, 3654 bp, Homo sapiens
tgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcaacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataaggttgcatgaacaagatttaaacaagagacttgaaaaagagttggatgtcatgacagcagaccacctcagagagaaaaatatcatgcgggcagattttaataagactaacgagctactcaaggaaataaatgccgctttacaagtgtcattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaagcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgaggtatcagtaagatgcatgtgcatgagctcaaggaacatgactactggagtttccattacacattgttgcgtgccttgtaattttccccaaagacggtagggattcttttgttttcttaagtagcccaaagaatctttagttagaattaagaaaagtataaactatataacatctaacgggggaaattatatttttagtgttctccctttcctgggagtatttgcatagggaattatgaaatgaaaatttaatgtaaaatgcatatagtaaaaaatactagtagttactttagttatatttaaggacacatctgtacgatcagctaaaagagaaaaggtgctgaaagagaggacccattattttattctctcgtttcccaccaattcttactggaattttttattcaaaggagggtgacatttttgccagttgttttttgttctttgtgattgttgtgatgtggctcctccttaactgacttcatttgagctgctgatgcactcttatgctctcatggagtggagaaccgattctagtatagagggggtagcaaatctttaaaacacgacttacaacatggggaacccgttgtggtaatctatgctgatgttttatgtgcttttgccttcattttgcaaaatgacttaatgctgggttacatgtctctctttttatgaattcagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaaaaaaaaaat

SEQ ID NO: 376191 - DNA, 1051 bp, Homo sapiens
tgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagaggcaagaattctttagacctgttgcctatgttatagattttaataataataacttattctggtgacattgtataggtaggtaagtctcagtaaaggtaacatatctagaataaaaataatttaaaaactttaa

SEQ ID NO: 376192 - DNA, 7382 bp, Homo sapiens
ataaggccttctaagagatctaagcagagtaagaatatgtctgattggaaatatattgtttttcttggctaatttgaccaagggctctagaaattatatggagggtatatgccagccgtactcttgttttttagtttcttgtctaagcaaaaaaattgttcttttgctatagacgcaatagaactaaatctatagtgttatgcacgttacttgtaaattcttatgtcaggaccaaatggtcgcttatattttttccagctcccaaattccctttattccactttagtcccttcattttcagagatgaggaaacagattgctttgttcaaagacagctagaactagaacacaggctaatacttgctagccatgtgatatactaatgtcagccaaatacgggcatttacactttcagatgtttgccatatctgtgcacttactaattctgtttaatacaatttaaattgactcctttaaataagcttattttaaaggaaattttttgctactataaatagaaaaccattatatcctttaaatagtaactctaaataggaattcaaaacaaagcaacgttattaaaatttaatttaaaattaatttaaatttaattgttattaaatttttaattattgctgttcttcgtcagaaatgtgtcaaagcattgttttcatgtttgatgtcagttccttaattgtctaaacagaaaaagcacagctaatgcctctagttaagcttctgtataacttttttaaatgaaatgcttcttagaggggaaatgagagggcatgaatacatgtttatatactaaagtatgatttcatgtatatcagaagatcttattatatggaaccaaaattattctttggttgatttaattgttcttgaaacttcagtttttaccttgaaggttttagttagcttagcataagtttatttttctaaataaggaatctgattgcctcacaactcagatgtatcacagttatggtgaaatagcaatatattggtttctgtaaccttttaaataccgtaatgaattaaaatctcttcagcaaaagcaaatatatctagggtgacgagaggtgtttttagtgtatttgaatgatggaaatgtttttcttaaaatatttctgaagcattttttaaaataattttttgaatttattgatgatagtagttgtgtgttagtgtgaatgactggtctaaatgtgtatgtcacttccaagggattagtaggggtcagaatgatttgttttattcattgacttttcctttgacgtgttcttattcattgggctacatacattccctgttgccttctcaccaaaagtgccactacacaggctgtatttcattgtactgtagaaaaagacaagtagacctttttcattcatgagattcctatgaaatctgttggtggaggtataaaatgaggagacttttatgggctagctagtaggagttttgctgtgaaacctttgtaacaggtctatcaggaactagggagagaaataaatgcaggaaatacttgatcccattaaactgaggatgaaaaagacatgataatattttggggattatttattgtgtgattttccggctgatcagaagtgttaattttttgttatacttgtgtcaaatacatatatatatatatattttgaaatggagtcttgctctgtcacccaggctggagtgcagtggtgcgatctgggttcactgcaacctctgcctccaggttcaagtgatcctcctgcctcagcctcccgagtagctaggactacaggcacgtgccaccacgccctgctaatttttgtattcttagtggagatggggtttcaccatgttggccaggctggtcttgaactcctgacctcaagtgatcttcccaccttggcctttctgaactatttcctttacacacatttagaactacatctaactgtattatagttttcactttcaccatcagacaaaattcagaagattcaagagaaggaaagtcgattgtatttactcatatttttgctaccgtgtttttacatctcatattttaaggctctcttaattatttattttctgtttagttaatttcctctagccattctttatttatagtgggtctgctggtaacaaattctctcaatttttcctcgtctgagaatgtcttgacttcccttccatttttgtcagcacctgaaaaatactatgccactatcttctgggttctgtggtttctgatgagaactccactgtcagtctaattgtcgttataaatgcagtgttctctctctctctctgcttccaggatattttttcttttttttttttttttttttcttgagacggagtctcactctgtcgcccaggctggagtgcagtggcgcaattttggctcactgcaagctctgcctcccgggttcaagcgattactcccactttagcctcccaagtagctaggactacaaggcacaccaccatgcctggctaatttttgtatttttagtagagacggggtttcaccatgttgcccaggctggtctcgaactcctgacatcaagtgatcttcctgcctccgcttcccaaagtgctggaattacaggcgtgagccactgctcccagcctctttattttttcagctttactctttcttctgtctttttgacatgtgtgtccagtgacacacgtgttagattttgctatagtctcacgcacgggtctataaggctctgttttttgtttcattttgtttttcctattttctctctattcagatcgagtaatttccactgttcagttttatcatagctgcttttaaatctttgtcaggtaattctgtcatctaagttttggcacctattgattatcttttgcattgtttttgtttttgtttctgtttttgttttgagatggagtcttgctctgttgcccaggttggagtgcagtggcactgatctcggctcactgcaacctcctcctcccgggttcaagtggttctcctgcctcaacctccttagtagctgggattacaggcatgtgccaccacgcccggctaattttgtatttttagtagagaccaggtttatccatgttggtcaggctggtctcaaactcccaacctcaagtgatccgcctgcctcgacctcccaaagtgctgggattacaggcgtgaaccactgcacccagcctatcttttgcattgttttaaatcttgttcttgctaggatgaatgattttctgttaaaactagatattttcatattatgttcctaggctctggatattatctaaaccttctgtttccactggcttttattgacactgctttggcaaggtcatagggggtgcctcattactgccaggtggacatagaagtcaagggtccctactcagcctctactgatgcctcaggaagaggatccttcttgttattgctgggtgggggtggaagtctagctgacacctactgaggtaggtgctggggcatgcccggccatcagggtgaaagtcctggctccctagttggcctacttttacattgccctaatagggcattggagctcctcactatggtttatgagctggaagtcaaggctcctcacttagctttcgttggtgtgggtggtggtggggcaaaactgttttctgggtttggctggagtggagcagttactgtcaaaagttttctgtcttgccaggctgtccctttcttgtttctttggctagagagagcaagcttttgttgtggctctttttgtctgtgccagttggcatttccaggttgctgccttctttagctccaagtctgggatatattaggcaaaaagaaaacccagagaatttacaccaccgtgtcattccatgggtcctgaggtcccttacttagtctgccttctctccacttttcacagtcttctcatgttttgtatataatgtccagggtctttagttatacttagcagaaataaaagggaaaagtatgtctgctctatgcttctgtaagtggaagtcttcaaatttgcatttttgattcctttaaacagttttgtaaaatatataatcattattgggcaaaatgtcccataaaatgtatataccttgtgatggtttgcataatattgtgttcaagaggactgctgaaaaataacatctttatttaaactgaaacgaattgttcacattattaatgaaaacttttcccctctaggaaataatgcaaaaggtgtcccaaggctcctgaccagtgaacaaagatttgagaaagacagccaagctcatgttttctcctgatcaagaaaatcatccatctaaagcaccagtaaaatatggtgaactcattgtcttagggtataatgggtctctcccaaatggcgatagaggaaggaggaaaagtaggtttgctttgtttaaaagacctaaggcaaatggggtgaagcccagcactgtgcatattgcttgtactcctcaggctgcaaaggcaataagcaacaaagaccagcatagcatatcatatactttatctcgggcccagactgtggtggttgaatatactcatgacagcaacaccgatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaatacataa

SEQ ID NO: 376193 - DNA, 4782 bp, Homo sapiens
  misc_feature (846)..(846): n is a, c, g, or t
taaatttagcatagtaactacagtattagaacttcaaatcacatagattttaatggtatcaatgacaaacagctcttaactaccaaaaacttttccagattaaattcttctagcaggaaatttgagagtcatttgaagaatagtttaatatttagcttagggttttaaaccgccagtcttagcctatgggttcctcagttaatcattagcaacagtaattgtctctgtgtctggtacttggtgtcttaaaatgcagataatttttcttctcaaccctctagaagtgaagctggacaaggtttcatgctgttgctgcttagaaaagagctttgaactacaggaacgcaatgtgggactaaagagcaagatccagaagtgggatgagtcatgcaactcagaggacagtagtgaaggggcagtgaggaatcgacagagggtctgggggcaatacaaagcctaaaatagctaaaataattattagctaaggggctgtactttggacttacagcaaggctagcaacattaccaagggctttctccaatacaaagtattttattttttataaagggtcaatgtagtttctatatatggcagtcattgagtaaactctcttctcagctttaaaacattcttccttgccagccacaattacaggccattttataatcacttcctcctccagcctcaaaactgtccctgttccctgcttcctttccccctagattgaccaactacatatggtagatcatcaaacccaagatttgtcagggggcgggggcaggggaggtggacggtgaatgaggaaagattattattaagctactgctcatgcctcaatgaagcantaaagaatgacataaccacatgacaaacatacttaaattcaaattctggctttgccagtgtcacttcagaatataattcttctgagtctgtttcctaatgtacaaaaatggggacagtgatttcaatctagtagaatttttgcaagggtagatttagtgaggtgatgtgtatgggatagcattcaatagtgcctggtacatagtaaacacccaaatatttttattttgtttttaacttgtttccattggtttagtacttgcttacctttaggatgtatatgtgtgtgtgtgtgtatgtgtacatgttatggagaaatggtcataagatctgaacaacaaaagtatgtttactacttagcaaacatgtctgttggacaggttctgctaacataatgagagtgcatttgtacattcaggtagctaagacttaacaaatctaaaaattccttacttcaaaagttcagctatttaaagtgtttggttcacaattaaaggagattgtgttttaaacaatacatactgtactttttaaaggttgtattagcacatgcaaacagttcaccttaaaaaaacagaatgagtcataaggagtcagacatgccattaatcagctcttaattatcttccataaaagagggaaggaaaaaaatagagataacacgaatctgtgtataatccaaaaggttctctgtgacttggaatgaagccagaaaaagaatctcattttgtttcacacactggcacctggtatggagatcaacagttgctcaaaggaattttaaataattataatgtgttaatagataattaattgggaattgattctgcaaggcaaagtcaaacatttgttttataattgtgcagttcttgcaagagatcacctatactttttttcccccatcaggtataatgggtctctcccaaatggcgatagaggaaggaggaaaagtaggtttgctttgtttaaaagacctaaggcaaatggggtgaagcccagcactgtgcatattgcttgtactcctcaggctgcaaaggcaataagcaacaaagaccagcatagcatatcatatactttatctcgggcccagactgtggtggttgaatatactcatgacagcaacaccgatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaatacataa

SEQ ID NO: 376194 - DNA, 3280 bp, Homo sapiens
ccccggctagacccctcccctccttgcgagtgtatgtcagtgacccagaggcggtgtgaggcggagggaccgtcggggggcgccgccgccgcctccactagcagcagcggcagcagccctagtcccgcggtgcggtcgaattggtccccagccctccgggagcgcaccacaaagcagccccaacgcctctccctgcgtccgcggctcctcagcgctcggctccgtggtcaacttcccctcgctgggctcggctggcgggcgcggagggcagcggcggaacggcgggctgtctgctcgcgctccccgcgcacaacacttcaccctctcgcctcgggtctcgggggccgctctgggatcccggccaccagcaattgtccggcaataagcaacaaagaccagcatagcatatcatatactttatctcgggcccagactgtggtggttgaatatactcatgacagcaacaccgatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaatacataa

SEQ ID NO: 376195 - DNA, 4035 bp, Homo sapiens
ccccggctagacccctcccctccttgcgagtgtatgtcagtgacccagaggcggtgtgaggcggagggaccgtcggggggcgccgccgccgcctccactagcagcagcggcagcagccctagtcccgcggtgcggtcgaattggtccccagccctccgggagcgcaccacaaagcagccccaacgcctctccctgcgtccgcggctcctcagcgctcggctccgtggtcaacttcccctcgctgggctcggctggcgggcgcggagggcagcggcggaacggcgggctgtctgctcgcgctccccgcgcacaacacttcaccctctcgcctcgggtctcgggggccgctctgggatcccggccaccagcaattgtccggaaataatgcaaaaggtgtcccaaggctcctgaccagtgaacaaagatttgagaaagacagccaagctcatgttttctcctgatcaagaaaatcatccatctaaagcaccagtaaaatatggtgaactcattgtcttagggtataatgggtctctcccaaatggcgatagaggaaggaggaaaagtaggtttgctttgtttaaaagacctaaggcaaatggggtgaagcccagcactgtgcatattgcttgtactcctcaggctgcaaaggcaataagcaacaaagaccagcatagcatatcatatactttatctcgggcccagactgtggtggttgaatatactcatgacagcaacaccgatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaatacataaaaaaaaaaaaaaaaaaaaaaaaaaaaaaaaaaaaaaaaaaaaaaaaaaaaaaaaaaaacaaaaaaaaaaaaaagaaataaaaaatgagaaagaaaagaaaaaaacaaaaaaagaacaagaaacaacaaaaagacaaaaaataaaagttaaaaaactatagaaacaataagataaaaaaacgaaaaaaaagggaaacacacgtagactgtggggacaacaacatcgcggcagtcctgcgccagccaccatcagccaccaccaattcacactacctcaaccaacattacaataaatatctaaatttcaatattctccgaaatcgctcaactctacttcatcactgcttctccaaatccataaaattctaaactctatccatcaccacaactcacatatcaccgtataacacctccctcctacattcttcacaacattattcactttcactcacaaaacgcaccagtccacattcaatcatatacccc

SEQ ID NO: 376196 - DNA, 3557 bp, Homo sapiens
ccccggctagacccctcccctccttgcgagtgtatgtcagtgacccagaggcggtgtgaggcggagggaccgtcggggggcgccgccgccgcctccactagcagcagcggcagcagccctagtcccgcggtgcggtcgaattggtccccagccctccgggagcgcaccacaaagcagccccaacgcctctccctgcgtccgcggctcctcagcgctcggctccgtggtcaacttcccctcgctgggctcggctggcgggcgcggagggcagcggcggaacggcgggctgtctgctcgcgctccccgcgcacaacacttcaccctctcgcctcgggtctcgggggccgctctgggatcccggccaccagcaattgtccggaaataatgcaaaaggtgtcccaaggctcctgaccagtgaacaaagatttgagaaagacagccaagctcatgttttctcctgatcaagaaaatcatccatctaaagcaccagtaaaatatggtgaactcattgtcttagggtataatgggtctctcccaaatggcgatagaggaaggaggaaaagtaggtttgctttgtttaaaagacctaaggcaaatggggtgaagcccagcactgtgcatattgcttgtactcctcaggctgcaaagaaattgccttttgtttggattggagaagagactttggagacatggcaataagcaacaaagaccagcatagcatatcatatactttatctcgggcccagactgtggtggttgaatatactcatgacagcaacaccgatatgtttcagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaatacataa

SEQ ID NO: 376197 - DNA, 4159 bp, Homo sapiens
  misc_feature (846)..(846): n is a, c, g, or t
taaatttagcatagtaactacagtattagaacttcaaatcacatagattttaatggtatcaatgacaaacagctcttaactaccaaaaacttttccagattaaattcttctagcaggaaatttgagagtcatttgaagaatagtttaatatttagcttagggttttaaaccgccagtcttagcctatgggttcctcagttaatcattagcaacagtaattgtctctgtgtctggtacttggtgtcttaaaatgcagataatttttcttctcaaccctctagaagtgaagctggacaaggtttcatgctgttgctgcttagaaaagagctttgaactacaggaacgcaatgtgggactaaagagcaagatccagaagtgggatgagtcatgcaactcagaggacagtagtgaaggggcagtgaggaatcgacagagggtctgggggcaatacaaagcctaaaatagctaaaataattattagctaaggggctgtactttggacttacagcaaggctagcaacattaccaagggctttctccaatacaaagtattttattttttataaagggtcaatgtagtttctatatatggcagtcattgagtaaactctcttctcagctttaaaacattcttccttgccagccacaattacaggccattttataatcacttcctcctccagcctcaaaactgtccctgttccctgcttcctttccccctagattgaccaactacatatggtagatcatcaaacccaagatttgtcagggggcgggggcaggggaggtggacggtgaatgaggaaagattattattaagctactgctcatgcctcaatgaagcantaaagaatgacataaccacatgacaaacatacttaaattcaaattctggctttgccagtgtcacttcagaatataattcttctgagtctgtttcctaatgtacaaaaatggggacagtgatttcaatctagtagaatttttgcaagggtagatttagtgaggtgatgtgtatgggatagcattcaatagtgcctggtacatagtaaacacccaaatatttttattttgtttttaacttgtttccattggtttagtacttgcttacctttaggatgtatatgtgtgtgtgtgtgtatgtgtacatgttatggagaaatggtcataagatctgaacaacaaaagtatgtttactacttagcaaacatgtctgttggacaggttctgctaacataatgagagtgcatttgtacattcaggtagctaagacttaacaaatctaaaaattccttacttcaaaagttcagctatttaaagtgtttggttcacaattaaaggagattgtgttttaaacaatacatactgtactttttaaaggttgtattagcacatgcaaacagttcaccttaaaaaaacagaatgagtcataaggagtcagacatgccattaatcagctcttaattatcttccataaaagagggaaggaaaaaaatagagataacacgaatctgtgtataatccaaaaggttctctgtgacttggaatgaagccagaaaaagaatctcattttgtttcacacactggcacctggtatggagatcaacagttgctcaaaggaattttaaataattataatgtgttaatagataattaattgggaattgattctgcaaggcaaagtcaaacatttgttttataattgtgcagttcttgcaagagatcacctatactttttttcccccatcaggtataatgggtctctcccaaatggcgatagaggaaggaggaaaagtaggtttgctttgtttaaaagacctaaggcaaatggggtgaagcccagcactgtgcatattgcttgtactcctcaggctgcaaaggtaaaaaaaaaaaaaaaaaagctacataaattaacttggagaatttgaaagacttttatgtgttgtttgtattctctagcattccccttacatttctatttcagaaattgccttttgtttggattggagaagagactttggagacatggtatttgaagagctgccatatggaaggggaattggacttttaaaaaaaaaatgacaaaccaggatcagtgggtggaaattagaaggaaacactctgtttccttattaaaagaggtgggatgggggacagggctttatctagtacttagaattatgcagctgtctgccctgagaagtgggaagttcccactctgttactagaggggtctccctggactggatgaagaatgtgatgtataatatgtgtattcaggtattagaagcacatttggatgaggtaatttttaaactaagggtctttacttaagattctttgtattggttgtattcatttttggtttataacttcatatatttgagcatagtaccttgcacaaagtagacctcaataattattaagttgaatcaaagctatgaaggcaatatccaactgcatctacaatataacttctcaaccccctagcctatttcatgcttctagcccccttgtattcttctaacaaaatttccagaagctggaccaccatttcaggatacttgggcttttcctagagtgacagacaaggagggggaatttcacatctttatattttctgtgaattcatctgcctccaattttataacactgactttgtgttacaaagaatttaatattgtaatgagcaaataagaaaaattagaaagagttctttgactcctggaagtacctgtatctttagctaagtagccctaggatgtacattaatattataccatctgaagcatatctttgtaaattaaataaacaagagacagaaaaattggcatatgatgtggttttaggttgcagcttcagtgtctgaaggtaattggcttttcagctttgttttatatccagtttgatttgtgaaagaatccttaggccttgactaggactcctctgttactatttgggagccagttggtgcagaaaagggacagtttctttttgctcctttggcgagaaggaatatactaagcaggtggtggaagtaaacctcagattgattgaatctgaggagcttcttacagtagctccccccggagtgctcttgacattttgggtatgccactttttcattgttcagtactttcccacatactacaggacatttataggtccttcacccacaaaatgccatttgagcctgcaaatcctcgtaacagccaaaaaatgcacagcatattttcagatgccccttagactgctaatactacctctggttgaaaaccactatcagggaaaatatttctaatccctgcctctgtaataccatattctgtacttttcttcctattttactctgccatgccctcatgttttcattgttatctctttttcatctttcatctttactaggcaataagaatcttagggatcacagattgactcttggctgggtgcggtagctcacacctataatcccagcacttgagaggccaaggtgggcggatcacttgagctcgggagttcgagaccagcctgggcaacatggtgaaactccatctccaccaaaaatacaaaaaattagccaagcgtggtggcatgccccgaagtcccagctacttggcaggctgaagtgggaggatcacttgagcccgggaggcagaggctgcagtgagctgagatcatgccactgtactgcagcctgagtgacagagtgagaccctgtctcagttaaaaaaaaaaaaaaaaaaagattgactcctcctctttaaattttggaggaatgtatttgtgaggtcatgatgaaaattaagcatttagtctggcagtcatctgggatgagtagttaaaaccctgcgttctaggccagtgagactcaaacgtaacttgacatagtttttattctcagtcttagagtaggtttaataactaacaaacaaagattacaatttcaaagcacataaaaaccaatgttttaaaatctctttagccactaagaattaattttcaaaatactgagtaattgtttcattgaaaagtgagctgtttaacggggcacagtggcacatgcctgttagtcccagctccttgggaggcagaggttacagtgagccgagatagcaccactgcactgcaacctaggcgacagagcgagactctgtctcca

SEQ ID NO: 376198 - DNA, 3908 bp, Homo sapiens
  misc_feature (846)..(846): n is a, c, g, or t
taaatttagcatagtaactacagtattagaacttcaaatcacatagattttaatggtatcaatgacaaacagctcttaactaccaaaaacttttccagattaaattcttctagcaggaaatttgagagtcatttgaagaatagtttaatatttagcttagggttttaaaccgccagtcttagcctatgggttcctcagttaatcattagcaacagtaattgtctctgtgtctggtacttggtgtcttaaaatgcagataatttttcttctcaaccctctagaagtgaagctggacaaggtttcatgctgttgctgcttagaaaagagctttgaactacaggaacgcaatgtgggactaaagagcaagatccagaagtgggatgagtcatgcaactcagaggacagtagtgaaggggcagtgaggaatcgacagagggtctgggggcaatacaaagcctaaaatagctaaaataattattagctaaggggctgtactttggacttacagcaaggctagcaacattaccaagggctttctccaatacaaagtattttattttttataaagggtcaatgtagtttctatatatggcagtcattgagtaaactctcttctcagctttaaaacattcttccttgccagccacaattacaggccattttataatcacttcctcctccagcctcaaaactgtccctgttccctgcttcctttccccctagattgaccaactacatatggtagatcatcaaacccaagatttgtcagggggcgggggcaggggaggtggacggtgaatgaggaaagattattattaagctactgctcatgcctcaatgaagcantaaagaatgacataaccacatgacaaacatacttaaattcaaattctggctttgccagtgtcacttcagaatataattcttctgagtctgtttcctaatgtacaaaaatggggacagtgatttcaatctagtagaatttttgcaagggtagatttagtgaggtgatgtgtatgggatagcattcaatagtgcctggtacatagtaaacacccaaatatttttattttgtttttaacttgtttccattggtttagtacttgcttacctttaggatgtatatgtgtgtgtgtgtgtatgtgtacatgttatggagaaatggtcataagatctgaacaacaaaagtatgtttactacttagcaaacatgtctgttggacaggttctgctaacataatgagagtgcatttgtacattcaggtagctaagacttaacaaatctaaaaattccttacttcaaaagttcagctatttaaagtgtttggttcacaattaaaggagattgtgttttaaacaatacatactgtactttttaaaggttgtattagcacatgcaaacagttcaccttaaaaaaacagaatgagtcataaggagtcagacatgccattaatcagctcttaattatcttccataaaagagggaaggaaaaaaatagagataacacgaatctgtgtataatccaaaaggttctctgtgacttggaatgaagccagaaaaagaatctcattttgtttcacacactggcacctggtatggagatcaacagttgctcaaaggaattttaaataattataatgtgttaatagataattaattgggaattgattctgcaaggcaaagtcaaacatttgttttataattgtgcagttcttgcaagagatcacctatactttttttcccccatcaggtataatgggtctctcccaaatggcgatagaggaaggaggaaaagtaggtttgctttgtttaaaagacctaaggcaaatggggtgaagcccagcactgtgcatattgcttgtactcctcaggctgcaaaggtaaaaaaaaaaaaaaaaaagctacataaattaacttggagaatttgaaagacttttatgtgttgtttgtattctctagcattccccttacatttctatttcagaaattgccttttgtttggattggagaagagactttggagacatggtatttgaagagctgccatatggaaggggaattggacttttaaaaaaaaaatgacaaaccaggatcagtgggtggaaattagaaggaaacactctgtttccttattaaaagaggtgggatgggggacagggctttatctagtacttagaattatgcagctgtctgccctgagaagtgggaagttcccactctgttactagaggggtctccctggactggatgaagaatgtgatgtataatatgtgtattcaggtattagaagcacatttggatgaggtaatttttaaactaagggtctttacttaagattctttgtattggttgtattcatttttggtttataacttcatatatttgagcatagtaccttgcacaaagtagacctcaataattattaagttgaatcaaagctatgaaggcaatatccaactgcatctacaatataacttctcaaccccctagcctatttcatgcttctagcccccttgtattcttctaacaaaatttccagaagctggaccaccatttcaggatacttgggcttttcctagagtgacagacaaggagggggaatttcacatctttatattttctgtgaattcatctgcctccaattttataacactgactttgtgttacaaagaatttaatattgtaatgagcaaataagaaaaattagaaagagttctttgactcctggaagtacctgtatctttagctaagtagccctaggatgtacattaatattataccatctgaagcatatctttgtaaattaaataaacaagagacagaaaaattggcatatgatgtggttttaggttgcagcttcagtgtctgaaggtaattggcttttcagctttgttttatatccagtttgatttgtgaaagaatccttaggccttgactaggactcctctgttactatttgggagccagttggtgcagaaaagggacagtttctttttgctcctttggcgagaaggaatatactaagcaggtggtggaagtaaacctcagattgattgaatctgaggagcttcttacagtagctccccccggagtgctcttgacattttgggtatgccactttttcattgttcagtactttcccacatactacaggacatttataggtccttcacccacaaaatgccatttgagcctgcaaatcctcgtaacagccaaaaaatgcacagcatattttcagatgccccttagactgctaatactacctctggttgaaaaccactatcagggaaaatatttctaatccctgcctctgtaataccatattctgtacttttcttcctattttactctgccatgccctcatgttttcattgttatctctttttcatctttcatctttactaggcaataagaatcttagggatcacagattgactcttggctgggtgcggtagctcacacctataatcccagcacttgagaggccaaggtgggcggatcacttgagctcgggagttcgagaccagcctgggcaacatggtgaaactccatctccaccaaaaatacaaaaaattagccaagcgtggtggcatgccccgaagtcccagctacttggcaggctgaagtgggaggatcacttgagcccgggagcgaggtacaggagccaatagacactgactgcactagcacagacgagacttgctcaaaaaaaaaaataaaactgagggggccggaccaatcgcctatggagcgatacattaatggcgcgttacaacgtggatggaaaactgcgtaccaactaatcgctgagacatctcttctgcagtgccgatacggtaatcggtaacttgtaacagcctgttaacattgcgaatggaatccttttataaagatgaccggagggtcgg

SEQ ID NO: 376199 - DNA, 3550 bp, Homo sapiens
ccccggctagacccctcccctccttgcgagtgtatgtcagtgacccagaggcggtgtgaggcggagggaccgtcggggggcgccgccgccgcctccactagcagcagcggcagcagccctagtcccgcggtgcggtcgaattggtccccagccctccgggagcgcaccacaaagcagccccaacgcctctccctgcgtccgcggctcctcagcgctcggctccgtggtcaacttcccctcgctgggctcggctggcgggcgcggagggcagcggcggaacggcgggctgtctgctcgcgctccccgcgcacaacacttcaccctctcgcctcgggtctcgggggccgctctgggatcccggccaccagcaattgtccggaaataatgcaaaaggtgtcccaaggctcctgaccagtgaacaaagatttgagaaagacagccaagctcatgttttctcctgatcaagaaaatcatccatctaaagcaccagtaaaatatggtgaactcattgtcttagggtataatgggtctctcccaaatggcgatagaggaaggaggaaaagtaggtttgctttgtttaaaagacctaaggcaaatggggtgaagcccagcactgtgcatattgcttgtactcctcaggctgcaaaggcaataagcaacaaagaccagcatagcatatcatatactttatctcgggcccagactgtggtggttgaatatactcatgacagcaacaccgatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaatacataa

SEQ ID NO: 376200 - DNA, 3178 bp, Homo sapiens
agcctaggcaacagagcaagactctgtctttaaaaaaaaagaaagaaagttatgtttttattctgtaactgcttctaaatattcttcagtaccccattcaacccgagaaactactgtcacagctgacaggagttattaacctctctaaatttcagggggaaaatgtataaatatgtcatgtatttgataaatagttttcccttttttttaatgaaaagattatctgattggattgacctgcctactaatttttgctattaactttttcattcttaggcaataagcaacaaagaccagcatagcatatcatatactttatctcgggcccagactgtggtggttgaatatactcatgacagcaacaccgatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaatacataa

SEQ ID NO: 376201 - DNA, 3753 bp, Homo sapiens
ccccggctagacccctcccctccttgcgagtgtatgtcagtgacccagaggcggtgtgaggcggagggaccgtcggggggcgccgccgccgcctccactagcagcagcggcagcagccctagtcccgcggtgcggtcgaattggtccccagccctccgggagcgcaccacaaagcagccccaacgcctctccctgcgtccgcggctcctcagcgctcggctccgtggtcaacttcccctcgctgggctcggctggcgggcgcggagggcagcggcggaacggcgggctgtctgctcgcgctccccgcgcacaacacttcaccctctcgcctcgggtctcgggggccgctctgggatcccggccaccagcaattgtccggaaataatgcaaaaggtgtcccaaggctcctgaccagtgaacaaagatttgagaaagacagccaagctcatgttttctcctgatcaagaaaatcatccatctaaagcaccagtaaaatatggtgaactcattgtcttagggtataatgggtctctcccaaatggcgatagaggaaggaggaaaagtaggtttgctttgtttaaaagacctaaggcaaatggggtgaagcccagcactgtgcatattgcttgtactcctcaggctgcaaaggcaataagcaacaaagaccagcatagcatatcatatactttatctcgggcccagactgtggtggttgaatatactcatgacagcaacaccgatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaatacataattgaattcgtctctgtgagttcatttttgcataatcgagaatgagaaaccagaagtgaaaactgtgaacaactctattccacactccaaaaatactcatttgaaatagatgaagagtttgcatttaatgtaacactttaaagtatctggttcttttttaaaagcatctcttactaataaaggaactttgttagtggttgaata

SEQ ID NO: 376202 - DNA, 2927 bp, Homo sapiens
ccccggctagacccctcccctccttgcgagtgtatgtcagtgacccagaggcggtgtgaggcggagggaccgtcggggggcgccgccgccgcctccactagcagcagcggcagcagccctagtcccgcggtgcggtcgaattggtccccagccctccgggagcgcaccacaaagcagccccaacgcctctccctgcgtccgcggctcctcagcgctcggctccgtggtcaacttcccctcgctgggctcggctggcgggcgcggagggcagcggcggaacggcgggctgtctgctcgcgctccccgcgcacaacacttcaccctctcgcctcgggtctcgggggccgctctgggatcccggccaccagcaattgtccggaaataatgcaaaaggtgtcccaaggctcctgaccagtgaacaaagatttgagaaagacagccaagctcatgttttctcctgatcaagaaaatcatccatctaaagcaccagtaaaatatggtgaactcattgtcttagggtataatgggtctctcccaaatggcgatagaggaaggaggaaaagtaggtttgctttgtttaaaagacctaaggcaaatggggtgaagcccagcactgtgcatattgcttgtactcctcaggctgcaaaggtaaaaaaaaaaaaaaaaaagctacataaattaacttggagaatttgaaagacttttatgtgttgtttgtattctctagcattccccttacatttctatttcagaaattgccttttgtttggattggagaagagactttggagacatggtatttgaagagctgccatatggaaggggaattggacttttaaaaaaaaaatgacaaaccaggatcagtgggtggaaattagaaggaaacactctgtttccttattaaaagaggtgggatgggggacagggctttatctagtacttagaattatgcagctgtctgccctgagaagtgggaagttcccactctgttactagaggggtctccctggactggatgaagaatgtgatgtataatatgtgtattcaggtattagaagcacatttggatgaggtaatttttaaactaagggtctttacttaagattctttgtattggttgtattcatttttggtttataacttcatatatttgagcatagtaccttgcacaaagtagacctcaataattattaagttgaatcaaagctatgaaggcaatatccaactgcatctacaatataacttctcaaccccctagcctatttcatgcttctagcccccttgtattcttctaacaaaatttccagaagctggaccaccatttcaggatacttgggcttttcctagagtgacagacaaggagggggaatttcacatctttatattttctgtgaattcatctgcctccaattttataacactgactttgtgttacaaagaatttaatattgtaatgagcaaataagaaaaattagaaagagttctttgactcctggaagtacctgtatctttagctaagtagccctaggatgtacattaatattataccatctgaagcatatctttgtaaattaaataaacaagagacagaaaaattggcatatgatgtggttttaggttgcagcttcagtgtctgaaggtaattggcttttcagctttgttttatatccagtttgatttgtgaaagaatccttaggccttgactaggactcctctgttactatttgggagccagttggtgcagaaaagggacagtttctttttgctcctttggcgagaaggaatatactaagcaggtggtggaagtaaacctcagattgattgaatctgaggagcttcttacagtagctccccccggagtgctcttgacattttgggtatgccactttttcattgttcagtactttcccacatactacaggacatttataggtccttcacccacaaaatgccatttgagcctgcaaatcctcgtaacagccaaaaaatgcacagcatattttcagatgccccttagactgctaatactacctctggttgaaaaccactatcagggaaaatatttctaatccctgcctctgtaataccatattctgtacttttcttcctattttactctgccatgccctcatgttttcattgttatctctttttcatctttcatctttactaggcaataagaatcttagggatcacagattgactcttggctgggtgcggtagctcacacctataatcccagcacttgagaggccaaggtgggcggatcacttgagctcgggagttcgagaccagcctgggcaacatggtgaaactccatctccaccaaaaatacaaaaaattagccaagcgtggtggcatgccccgaagtcccagctacttggcaggctgaagtgggaggatcacttgagcccgggaggcagaggctgcagtgagctgagatcatgccactgtactgcagcctgagtgacagagtgagaccctgtctcagttaaaaaaaaaaaaaaaaaaagattgactcctcctctttaaattttggaggaatgtatttgtgaggtcatgatgaaaattaagcatttagtctggcagtcatctgggatgagtagttaaaaccctgcgttctaggccagtgagactcaaacgtaacttgacatagtttttattctcagtcttagagtaggtttaataactaacaaacaaagattacaatttcaaagcacataaaaaccaatgttttaaaatctctttagccactaagaattaattttcaaaatactgagtaattgtttcattgaaaagtgagctgtttaacggggcacagtggcacatgcctgttagtcccagctccttgggaggcagaggttacagtgagccgagatagcaccactgcactgcaacctaggcgacagagcgagactctgtctcca

SEQ ID NO: 376203 - DNA, 2086 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattgggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacacaaaaaatgttttggttac

SEQ ID NO: 376204 - DNA, 926 bp, Homo sapiens
  misc_feature (553)..(553): n is a, c, g, or t
  misc_feature (911)..(911): n is a, c, g, or t
gacgtgaacgtgtagatagtagttaatatgatttgccgaaacagataaaaaaaagtttcaggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgcctcnttggcctaaaggtggagctctgcggccactacctttatcgagggtaaccacgatcctcattcatgactccttgcctacgtcgctcgttccgaccagcgcccattcccctttaatgacgaataccgctctccccacagccagggattcctcaggaataacctgtatgcaatggcctcctgtagcgcgaaacctgacaaagcccgttactagattaccaatacctcccccaccctgaccattccaccactcttttacatccacgtagtcatccccccgcttcgcattccactttttccccgataattacagatcatctttcgacccgcttggcactcatactatcaattctcttcgacgntaatctctaatcacg

SEQ ID NO: 376205 - DNA, 2421 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattgggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttggcctcgttggccaacagggggactttcagccgttacctttaagagggtaattatgatctcgttactgactctgcgtgcgacgacaattggcgagggtatattttctcaaggcgtttactgcttccccgatcaggtgttcgccgagataacatgtactaacagcctttaagccataccttaaacgcgtcgggtgggctttttagagacccgaccccagacttaaagatcacctaattacacgatgtttccgccggcctaagaaccagagagacagcgttcccacgtcagactaatgttcctcgttcacgtgtattatagtcgccgatgcaatcgtgacttattcggatgcgacgattcctatgtgcacatg

SEQ ID NO: 376206 - DNA, 2429 bp, Homo sapiens
  misc_feature (2056)..(2056): n is a, c, g, or t
  misc_feature (2414)..(2414): n is a, c, g, or t
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattgggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgcctcnttggcctaaaggtggagctctgcggccactacctttatcgagggtaaccacgatcctcattcatgactccttgcctacgtcgctcgttccgaccagcgcccattcccctttaatgacgaataccgctctccccacagccagggattcctcaggaataacctgtatgcaatggcctcctgtagcgcgaaacctgacaaagcccgttactagattaccaatacctcccccaccctgaccattccaccactcttttacatccacgtagtcatccccccgcttcgcattccactttttccccgataattacagatcatctttcgacccgcttggcactcatactatcaattctcttcgacgntaatctctaatcacg

SEQ ID NO: 376207 - DNA, 1838 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttgccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattgggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacacaaaaaatgttttggttac

SEQ ID NO: 376208 - DNA, 2107 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattgggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttaggatttatttctattaaatacaggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacacaaaaaatgttttggttac

SEQ ID NO: 376209 - DNA, 1675 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacaggatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacacaaaaaatgttttggttac

SEQ ID NO: 376210 - DNA, 1858 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattgggagaggaagcgatgatcaattacgaaaactttttgaaggcaatttttcacagcaaaagtctttgctaaactccttcatacagattcatatggaagaatttccatcatgcagttctttaattatgtcatgagaaaaggatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacacaaaaaatgttttggttac

SEQ ID NO: 376211 - DNA, 1269 bp, Homo sapiens
tatatgtattggttcatatttgcatctgttacctttgggaagctgcatcagaagttgataatacaagttacttaacctttggggagaagaaataggtgagaggctttttaatcaatatctttgttccctttgaatttggaactatgtagaatttactacttttcaaaaatgctaaaacttaaattagaaacaaaatttaatgtaaaatagttttaccactaaaatagtcatgcatttatttctttatcaatatagtattaatgctgaataatttttagtaatgaaattctaatatctaatgaatcaagactggacatttaacactttattttgttttattttcaggatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacacaaaaaatgttttggttac

SEQ ID NO: 376212 - DNA, 1406 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattgggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggtaaaagaaaatcttatctaacttagatattatgaggatattattatatctaaatctcaataactagagaaaactcttgaaaaatatcatttattttcctgtcactgccat

SEQ ID NO: 376213 - DNA, 1330 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacaggtaagaacaaagcaaaaagttgctttagatgttaaccatttctcatttgtgctacttaaatcatgcaggatttcttggtgcctaatggagtccgtactacagagtggtactacataggctctgaagcagcagttcccaccagaagcagccgctgagtttgcatgggtcatgtaccccaaacatagtgttgtttgttatttttgtttaaggccctaggtgattctaatgtgcagccaaggttgagaaccactgctgtagggtcagactacagaggttcaaatcccagccctgctatatgactttaggcaatggacttaacatctctgtgcttcgattatcatctctaaagtagggatagctaactatatcatagagatgtggattaaagaggcagtgtatatcaaaagcttagtaggcactcaataaatgttatttttattgttagtaatca

SEQ ID NO: 376214 - DNA, 515 bp, Homo sapiens
agagaaaaggaaactgcctgttaaatggaaaagaaaaaaagtagaacaaaaaattaacataagcccaagtggcagccctcaattttattcctctgtacttcagtggatgcaaacagccctgaattttggatcactatgtgtgatagaaattaagtggatcaaatttcattgtatttttttttctcttgcaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacacaaaaaatgttttggttac

SEQ ID NO: 376215 - DNA, 210 bp, Homo sapiens
gtgaacaagaattaaaagatgaagaaatggatttatttacaaaatattactccgaatggaaaggaggtagaaaaaacacaaatgaattctataagaccattccccggttttattatagggtaagtagtgtctaatcaaatgtcctgcagagtttaaaaatgaaatataatttttggcaaggcagggtggctcatacctgtaatcccaaca

SEQ ID NO: 376216 - DNA, 325 bp, Homo sapiens
taagtgaaacagcccagagactatggccttcatgatgggtttttttggctgtttctagcccaagggtttttctgatcaagattgcaaaggtagctgatagtattacacataggccactaccctaatcataacatgaatagtttgaaaatcaaaatattaaccaagaaaaaactttttgttagtctattcttctgattaaaattttattgtggtcataagtgtctttattatttttcttcccaaggccagtacttgaatcttgataaagatcacaatggcatgctcagtaaagaagaactctcacgctatggaacagctaccatga

SEQ ID NO: 376217 - DNA, 1966 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttgccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattgggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacacaaaaaatgttttggttac

SEQ ID NO: 376218 - DNA, 1958 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattgggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacacaaaaaatgttttggttac

SEQ ID NO: 376219 - DNA, 1972 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacaggcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacacaaaaaatgttttggttac

SEQ ID NO: 376220 - DNA, 1975 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattgggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgatttagaaaactacatattggaacttatccctacgttgccacaattagatggtctggaaaaatctttctactccttttatgtttgtacagcagttaggaagttcttcttctttttagatcctttaagaacaggaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagactttaaagcaaaatcctcagaaatggtctaaataaaacacttgatatgcctagagaacacaaaaaatgttttggttac

SEQ ID NO: 376221 - DNA, 1705 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttgccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattgggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaagtttggcttcatcaaacaagaataggactcagtttatatgatgtcgctgggcaggggtaccttcgggaatctgaaagataaaaattcaagatattttagcatgcagcttcctagatgatttattggagctaagggatgaggaactgtccaaggagagtcaagaaacaaattggttttctgctccttctgccctaagagtttatggccagtacttgaatcttgataaagatcacaatggcatgctcagtaaagaagaactctcacgctatggaacagctaccatgaccaatgtcttcttagaccgtgttttccaggagtgtctcacttatgatggagaaatggactataagacctacttggactttgtccttgcattagaaaacagaaaggaacctgcagctctacaatatattttcaaactgcttgatattgagaacaaaggatacctgaatgtcttttcacttaattatttctttagggccatacaggaactaatgaaaatccatggacaagatcctgtttcatttcaagatgtcaaggatgaaatctttgacatggtaaaaccaaaggatcctttgaaaatctctcttcaggatttaatcaacagtaatcaaggagacacagtaaccaccattctaatcgatttgaatggcttctggacttacgagaacagagaggctcttgttgcaaatgacagtgaaaactctgcagaccttgatgatacatgatctctgaaagactagactgtcttatattatgagatacttgaatgctgcatgtaaagcctttaaagcaaaatcctcagaaatggtctaaataaaacacttgatatgcctagagaacacaaaaaatgttttggttac

SEQ ID NO: 376222 - DNA, 1519 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattgggagaggaagcgatgatcaattacgaaaactttttgaaggttggtgaaaaggctggagcaaagtgcaagtaagaataatataattaacaaaagaatgtgttatgttaagcattttaaatgcctcaaatattggctgggcacagtggctcacacctgtaatcccagcagttttggaggctgaggtgagaggattgcttgagctggggtgtttgaggccagcctgggcaacttagggagatcttgtctctactaaaaaaattatctgggtgtgggggcgtacacctgtagctactccggaggctgaggtgggagaattgcttgagcccgggaggatgagctgtgattaagccactgcactccagcctgggcgatagagcaagaccttacctttaaaaaaaataaacaaatcctcaaatattaaatgaagtaaatggaatgacatttgagtccatttaagttactaattaaatttaataaaattatttacagtcaaaaaatcacattggtatgaagttattaaaataaataatatagccagaagtgctgggattacaggcaagagccactgcgcctggccaaatctccatttctttt

SEQ ID NO: 376223 - DNA, 840 bp, Homo sapiens
tgcccacgatgcaccgcgccagccccgaccgacggacgagactgacccggacttaggcgttccgcctggcccggcggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttggtgagcttgggtcgcctctgaaggagaaccattttccatctctttcatagttttttcccccagtcagcgtggtagcggtattctccgcggcagtgacagtaattgtttttgcctctttagccaagacttccgccctcgatcaagatggtggttggacggccttcctaacctttacggggcctggcggtgctgacgcctgagctggtaggggtggagcaggtaggaaacagcaaatgcagaagctgctgcgcgggagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggggaggcatgagacatcaatcaaatacatttgagaaatacattggtttgatccagaaaggtgggaca

SEQ ID NO: 376224 - DNA, 3555 bp, Homo sapiens
gctcactgctggtgttgcctcttggaacctcggcagtttctgctttcgcacctgcagggtttagtctccgggactgcttgggaggacacctggaatgccgaaggcaggactacacaccgggcgaatccaccagcgccaccaagcccttgaaaacccgaggccgccgcgcgactccatttcccagcgccccgcgcggcaggggcttggacgttgccaaggagaccggtagtggccccgcctccacgcagggaaacaggcgggaaccacgtgacccggaaggctgtacgcaagcgtccgcggcgcgcactgggccaatgagaaccgaagggctggacttccggcggtgggactgtcacttcgccgcccgcgtcaggccacaccggtggtctgggctggggaccgcgggtcgggtccggtttccagggggttcctggtgctcgaggctggcggcgaggaaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagggaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatggaaaaaaaaaaaaaaaaaagactaccatctgcaactcagagtaggtgttgcagtttcctgtacagcagtttggacctccagagcacagcctcttgtccctactccagagcatggttcagtcttaatagcagttcaagagcttctctgataaaggtttctttttaaacatt

SEQ ID NO: 376225 - DNA, 671 bp, Homo sapiens
tcttaaaacatgagatgtttatgcaatttttattttttttagctcatcagctgttattagtgttaatgtattttatgtgttgcccaagacaattcttcttccaatgtggcccagggaagccaaaagattggataacccagccttagaccatggctgtctcttcctccctgctcttttaggaccagatggcctttgaggatgtggctgtgtacttctcccaggaggagtgggggctcctggacacagcccagagggccctgtaccgccgcgtgatgctagacaacttcgcacttgtggcctcgctgggtaaggtcctagatactccatgaaatgggcaactgataacaagctgactggccagggctgccccctcacctccctggtggctgacgagcaggcctataccttgcagccaggagccatgtggaataggggtctggtcctatagacatgcagtctggttggctcaaccactccctgtggcgctgtccggctgtggcctctccgagccttggctcagtccccttcctttggtgccctgggcacagttgctgccctggggatgaatgagctattcctgtctgtttccgtgaagccctgactcctgccctctgtttggaggtgggttatcttgagctggggctggactctaacctgcacctcctcctcac

SEQ ID NO: 376226 - DNA, 426 bp, Homo sapiens
atggcatgtagtgaggacatgaatttccttggaggtgaggctccaggtagggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatggaaaaaaaaaaaaaaaaaagactaccatctgcaactcagagtaggtgttgcagtttcctgtacagcagtttggacctccagagcacagcctcttgtccctactccagagcatggttcagtcttaatagcagttcaagagcttctctgataaaggtttctttttaaacatt

SEQ ID NO: 376227 - DNA, 3109 bp, Homo sapiens
tcttaaaacatgagatgtttatgcaatttttattttttttagctcatcagctgttattagtgttaatgtattttatgtgttgcccaagacaattcttcttccaatgtggcccagggaagccaaaagattggataacccagccttagaccatggctgtctcttcctccctgctcttttaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagggaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatggaaaaaaaaaaaaaaaaaagactaccatctgcaactcagagtaggtgttgcagtttcctgtacagcagtttggacctccagagcacagcctcttgtccctactccagagcatggttcagtcttaatagcagttcaagagcttctctgataaaggtttctttttaaacatt

SEQ ID NO: 376228 - DNA, 2476 bp, Homo sapiens
gctcactgctggtgttgcctcttggaacctcggcagtttctgctttcgcacctgcagggtttagtctccgggactgcttgggaggacacctggaatgccgaaggcaggactacacaccgggcgaatccaccagcgccaccaagcccttgaaaacccgaggccgccgcgcgactccatttcccagcgccccgcgcggcaggggcttggacgttgccaaggagaccggtagtggccccgcctccacgcagggaaacaggcgggaaccacgtgacccggaaggctgtacgcaagcgtccgcggcgcgcactgggccaatgagaaccgaagggctggacttccggcggtgggactgtcacttcgccgcccgcgtcaggccacaccggtggtctgggctggggaccgcgggtcgggtccggtttccagggggttcctggtgctcgaggctggcggcgaggaaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctgctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatggaaaaaaaaaaaaaaaaaagactaccatctgcaactcagagtaggtgttgcagtttcctgtacagcagtttggacctccagagcacagcctcttgtccctactccagagcatggttcagtcttaatagcagttcaagagcttctctgataaaggtttctttttaaacatt

SEQ ID NO: 376229 - DNA, 3272 bp, Homo sapiens
gctcactgctggtgttgcctcttggaacctcggcagtttctgctttcgcacctgcagggtttagtctccgggactgcttgggaggacacctggaatgccgaaggcaggactacacaccgggcgaatccaccagcgccaccaagcccttgaaaacccgaggccgccgcgcgactccatttcccagcgccccgcgcggcaggggcttggacgttgccaaggagaccggtagtggccccgcctccacgcagggaaacaggcgggaaccacgtgacccggaaggctgtacgcaagcgtccgcggcgcgcactgggccaatgagaaccgaagggctggacttccggcggtgggactgtcacttcgccgcccgcgtcaggccacaccggtggtctgggctggggaccgcgggtcgggtccggtttccagggggttcctggtgctcgaggctggcggcgaggaaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagggaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttgcggttggggccttacccactgttacccatatctctcatggggcgggaggctgtgaaattgttggtcagggtggggctccggggccccccggtggcttcgggggcaagggggggcttctggttagcgggcgggggcccgggtgttgaaaaacccccgtggggg

SEQ ID NO: 376230 - DNA, 3442 bp, Homo sapiens
gctcactgctggtgttgcctcttggaacctcggcagtttctgctttcgcacctgcagggtttagtctccgggactgcttgggaggacacctggaatgccgaaggcaggactacacaccgggcgaatccaccagcgccaccaagcccttgaaaacccgaggccgccgcgcgactccatttcccagcgccccgcgcggcaggggcttggacgttgccaaggagaccggtagtggccccgcctccacgcagggaaacaggcgggaaccacgtgacccggaaggctgtacgcaagcgtccgcggcgcgcactgggccaatgagaaccgaagggctggacttccggcggtgggactgtcacttcgccgcccgcgtcaggccacaccggtggtctgggctggggaccgcgggtcgggtccggtttccagggggttcctggtgctcgaggctggcggcgaggaaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagggaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatggaaaaaaaaaaaaaaaaaagactaccatctgcaactcagagtaggtgttgcagtttcctgtacagcagtttggacctccagagcacagcctcttgtccctactccagagcatggttcagtcttaatagcagttcaagagcttctctgataaaggtttctttttaaacatt

SEQ ID NO: 376231 - DNA, 3388 bp, Homo sapiens
gctcactgctggtgttgcctcttggaacctcggcagtttctgctttcgcacctgcagggtttagtctccgggactgcttgggaggacacctggaatgccgaaggcaggactacacaccgggcgaatccaccagcgccaccaagcccttgaaaacccgaggccgccgcgcgactccatttcccagcgccccgcgcggcaggggcttggacgttgccaaggagaccggtagtggccccgcctccacgcagggaaacaggcgggaaccacgtgacccggaaggctgtacgcaagcgtccgcggcgcgcactgggccaatgagaaccgaagggctggacttccggcggtgggactgtcacttcgccgcccgcgtcaggccacaccggtggtctgggctggggaccgcgggtcgggtccggtttccagggggttcctggtgctcgaggctggcggcgaggaaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagggaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatggaaaaaaaaaaaaaaaaaagactaccatctgcaactcagagtaggtgttgcagtttcctgtacagcagtttggacctccagagcacagcctcttgtccctactccagagcatggttcagtcttaatagcagttcaagagcttctctgataaaggtttctttttaaacatt

SEQ ID NO: 376232 - DNA, 840 bp, Homo sapiens
  misc_feature (837)..(837): n is a, c, g, or t
taaaaacttcaaaaaaaaaaaaaaaaaaaaaaaaaaaaaaaaaaaaaaaaaaaaatcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcattactgggtttgcccggtttaaggtttnttt

SEQ ID NO: 376233 - DNA, 3971 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376234 - DNA, 3403 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacataaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggcccaaaaaagacaccccaagaggggagccaacaacaattaggacccacccgagtttctgtgtaagacagcgggggacccacatagggggcggactattaaaagaccagcagaacgaggagccgcgtcaaaaaaaaacagcaaagagagggaaaaaaaagcagaagagggggaacatactagggggagaggacaccaccaacataagcgggggagggagcaacaaaaatgggggaagcaaaacaaccccccccaacaaaagaattaagaagccccacagagggaaaaaaaaaaaaccgaggagagataacgggggcagaccacaaccgaaaaatgttgagcggcaaagaaaatgagacacaacaagataatatagagaggaacataccccag

SEQ ID NO: 376235 - DNA, 3562 bp, Homo sapiens
aaagaaagaaagaaagaaagaaagaaagaaagaaagaaagaaagaaagaaaagaaagaaaagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376236 - DNA, 3953 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376237 - DNA, 3911 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctatactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376238 - DNA, 3230 bp, Homo sapiens
ggtactctaaggatccggtattgagtggcatgtgaagaggctgaaaccactgtttaataaactttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376239 - DNA, 3728 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgactgtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376240 - DNA, 3813 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376241 - DNA, 3159 bp, Homo sapiens
agtttttgaaaaatgagatttaatgtttagttgccggtatagatttgcatttggaggtgcttttttcccctactgcaggactaggcaatttttatattatttcattagattatgagaacttctagagaaatggaatcatatacttaatggtgattattcttggccatagaatcacacgctgtcacattttgtctgggcctttgcttctcttggactgacagcactctaactggttttctaagagttaccagccccctttttcatttagtatcactactcatttttccttttcagggaatgtatcttaggaaacagctgacaataaatgcagaggttatcctatctgagtttttactatttcccagttcttaagtatagatgtctttctctctctacaggtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376242 - DNA, 3634 bp, Homo sapiens
agtttttgaaaaatgagatttaatgtttagttgccggtatagatttgcatttggaggtgcttttttcccctactgcaggactaggcaatttttatattatttcattagattatgagaacttctagagaaatggaatcatatacttaatggtgattattcttggccatagaatcacacgctgtcacattttgtctgggcctttgcttctcttggactgacagcactctaactggttttctaagagttaccagccccctttttcatttagtatcactactcatttttccttttcagggaatgtatcttaggaaacagctgacaataaatgcagaggttatcctatctgagtttttactatttcccagttcttaagtatagatgtctttctctctctacaggtttgcatcactggttgctgtttatgttgttggggggttcctataccagcgactggtagtgggagccaaaggaatggagcagtttccccacttagccttctggcaggatcttggcaacctggtagcaagtaagtaacagggcagctggttgaatttgtagcctgcaaacaaggttgggtgaccaaccatcctcgtttgttcacactgagggggttcctgggacacaggacattgagtgctaaaaccacaaaagtcccagcaaacaagacagttgccctagtacagagtagtaagtggcacagcatccatttctggccttggtaagacattgctgaaagagcaacactgttgaccagatgggctcttctaaatctgatttagcttttaagagggcctgggtgggaagaaggtgaggcctaataagaagaaactttttctcctgttgccccaaattgaatttaggctgattgtcagatcttttaggtttctcattatccctatagaaaaccaattcttgccacattcctagaccataagtacactttctcatatcctaaagttagatgctgcgaattatttccttcttttttttccccctacaggatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376243 - DNA, 2662 bp, Homo sapiens
ggacgcgtgggtcgacccacgcgtccgagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376244 - DNA, 2563 bp, Homo sapiens
gcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376245 - DNA, 2934 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376246 - DNA, 2293 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgccatgtaattccggtgtaggtggagctgtattgggattccccaggtcacgttctccatgcccagctcttactgataaaggcccaggagatgttggagagagtgcttcatcataac

SEQ ID NO: 376247 - DNA, 2452 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376248 - DNA, 1912 bp, Homo sapiens
aggtgaatcgtacttatactggaccttcacgtcttcagtgttggtagtggtcatcgtttaactagcggtacttgactgagaactgctgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376249 - DNA, 2045 bp, Homo sapiens
ggccaagaccttatttaacagggtgaacgcttcaaggtgtaatcgggcgccaaagagcccccataaatgcgggaattcgtgtggctactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcacttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376250 - DNA, 1487 bp, Homo sapiens
  misc_feature (1374)..(1374): n is a, c, g, or t
  misc_feature (1404)..(1404): n is a, c, g, or t
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcaccgatgggtggatttggttgcggtaacccaaatggcnggcattggcggggggggccccgggggggcnacggggccctttaccgagggtattggctccgccccccaacaggcgattggcaccgcaccactgggccgggacacaaagacgct

SEQ ID NO: 376251 - DNA, 2209 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376252 - DNA, 2191 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376253 - DNA, 1641 bp, Homo sapiens
  misc_feature (16)..(16): n is a, c, g, or t
  misc_feature (73)..(73): n is a, c, g, or t
  misc_feature (80)..(81): n is a, c, g, or t
  misc_feature (84)..(84): n is a, c, g, or t
  misc_feature (106)..(106): n is a, c, g, or t
  misc_feature (120)..(120): n is a, c, g, or t
  misc_feature (126)..(126): n is a, c, g, or t
  misc_feature (153)..(153): n is a, c, g, or t
  misc_feature (155)..(155): n is a, c, g, or t
  misc_feature (160)..(161): n is a, c, g, or t
  misc_feature (170)..(170): n is a, c, g, or t
  misc_feature (173)..(173): n is a, c, g, or t
  misc_feature (195)..(195): n is a, c, g, or t
  misc_feature (213)..(213): n is a, c, g, or t
  misc_feature (223)..(223): n is a, c, g, or t
  misc_feature (228)..(229): n is a, c, g, or t
  misc_feature (237)..(238): n is a, c, g, or t
  misc_feature (242)..(242): n is a, c, g, or t
  misc_feature (252)..(252): n is a, c, g, or t
  misc_feature (256)..(256): n is a, c, g, or t
  misc_feature (258)..(258): n is a, c, g, or t
  misc_feature (264)..(265): n is a, c, g, or t
  misc_feature (286)..(286): n is a, c, g, or t
  misc_feature (321)..(321): n is a, c, g, or t
  misc_feature (353)..(353): n is a, c, g, or t
  misc_feature (368)..(368): n is a, c, g, or t
  misc_feature (374)..(375): n is a, c, g, or t
  misc_feature (387)..(387): n is a, c, g, or t
  misc_feature (390)..(390): n is a, c, g, or t
  misc_feature (392)..(393): n is a, c, g, or t
ttaaggaaactacaangtcccgctttgtgcaattggggcgcattgctttttaattcggttatatagccaggtnctcactnnccnttccatgcaaatttttcgaagnatttggggtgattngggttntgatttattttccaaagttgatgcggntnggganngtatttggnatntccttttggggggtgggcgcanttgatattttcccttttnttacaggggntcttnnaggctgannggtnatcttggcanttgngntcccgnntacggtcggggtatctcctcnatccgggaatttggagttcatcttccgctttgtgncgattcgcgccactctttctttaatgccgctngctttttggttttcncatggnnattccaatcccnttnanntatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376254 - DNA, 1143 bp, Homo sapiens
ggacgcgtgggtcgacccacgcgtccgagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376255 - DNA, 3478 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactgctgagtaggtgggacctgtggtggctgaggggcagtgagggtggtggcttgcggctgctgctgttgctgctgttgctgttgttgctgctgctgctgctgcgccaactggaggtgtgtagctgtgtgaaggagctgggactgccggtg

SEQ ID NO: 376256 - DNA, 4446 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcaagtaagtaacagggcagctggttgaatttgtagcctgcaaacaaggttgggtgaccaaccatcctcgtttgttcacactgagggggttcctgggacacaggacattgagtgctaaaaccacaaaagtcccagcaaacaagacagttgccctagtacagagtagtaagtggcacagcatccatttctggccttggtaagacattgctgaaagagcaacactgttgaccagatgggctcttctaaatctgatttagcttttaagagggcctgggtgggaagaaggtgaggcctaataagaagaaactttttctcctgttgccccaaattgaatttaggctgattgtcagatcttttaggtttctcattatccctatagaaaaccaattcttgccacattcctagaccataagtacactttctcatatcctaaagttagatgctgcgaattatttccttcttttttttccccctacaggatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376257 - DNA, 3461 bp, Homo sapiens
gtgtctgaaccctggcccacagtgctctcaaagcttttattaaacagtggtttcagcctcttcactagagccaactctttctctgactctttacccttttctcctaccaagtcgcaagttttttcttctgtctgccaggattctctctctgccacagccaggagtagtagtagcagtccagtcctccagcagctgtagaaagggaacatcgtgtcgtggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376258 - DNA, 3861 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376259 - DNA, 2337 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttttccccaggtcacgttctccatgcccagctcttactgataaaggcccaggagatgttggagagagtgcttcatcataac

SEQ ID NO: 376260 - DNA, 2902 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcaagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggca

SEQ ID NO: 376261 - DNA, 2123 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggcccaaaaaagacaccccaagaggggagccaacaacaattaggacccacccgagtttctgtgtaagacagcgggggacccacatagggggcggactattaaaagaccagcagaacgaggagccgcgtcaaaaaaaaacagcaaagagagggaaaaaaaagcagaagagggggaacatactagggggagaggacaccaccaacataagcgggggagggagcaacaaaaatgggggaagcaaaacaaccccccccaacaaaagaattaagaagccccacagagggaaaaaaaaaaaaccgaggagagataacgggggcagaccacaaccgaaaaatgttgagcggcaaagaaaatgagacacaacaagataatatagagaggaacataccccag

SEQ ID NO: 376262 - DNA, 1319 bp, Homo sapiens
cggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtgagtatgccttcctttatcagaacagaccttccttccttttgtttttaaggtcagtaactatatggtggtacataagcacaaattgtatgtgtacattatgctgtaa

SEQ ID NO: 376263 - DNA, 412 bp, Homo sapiens
  misc_feature (60)..(60): n is a, c, g, or t
ttgccctttggcccttttgtcaggggccaggggtctgccgggtgggggtgccaacaggcntggccctttcctcccctgcatccagccatgggggcctctgcgattgccggaaggttgcatggctggtcccagggccagcacaggcccgaggccgggctgcctggttttatttttatttaactttattttctgttttatgagtgtgcgaggcggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaaga

SEQ ID NO: 376264 - DNA, 1881 bp, Homo sapiens
taccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttctggcctgagcctgggcccagccacctcctgacgggtcccctgggtctgcataggtctcccatggcgcaatgagtcagtggcccccagccaggcagtgtgggcattgccactgcggctggacggggctgcgcgctcgcgctctctctctctctctctctctctctttgatctcagggggtccttttgggagtttattgtattttattgtacttggtggggtgtttggggtgggggcggaggagagcttgttctcgtggggttgtcggtaccttcagaaacttttaccaaagtcacgattagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggcggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacaaaacaaaaaacaagaaaaaaaaaacacaaaaccccgtaaaatcacaaagaaaatccaacaccaaaggcgcagaagccggctggccgtggtgggggcagcgtaggcgtagcatccctctcctctcacttagcctgttgactcttgttattatcatgatattcacaaaacgccgcatgtttaaaaagtcatagatgtcatcttctctctgcccccagggaggaaagccaccttctcttgccccttggcccctttgtcaggggccaggggtctgccgggtgggggtgccaacaggcctggccctttcctcccctgcatccagccatgggggcctctgcgattgccggaaggttgcatggctggtcccagggccagcacaggcccgaggccgggctgcctggttttatttttatttaactttattttctgttttatgagtgtgtgtccgcccacccccacccccttcagtgttaagtggggagccctgggggagtctctcctgcctcccagcctctcccaagacctcccccctcgtcaccagccatccctctggaccaggcagagggcggaccgggtgggcaggggcctgagggtggctcgggccagcccaccagccaatggacccctcctcaggccgccagtgtcgccctgcccctttttaaaacaaaatgccctcgtttgtaaacccttagacgcttgagaataaaccccttccttttcttcca

SEQ ID NO: 376265 - DNA, 1449 bp, Homo sapiens
taccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttcctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggcggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacaaaacaaaaaacaagaaaaaaaaaacacaaaaccccgtaaaatcacaaagaaaatccaacaccaaaggcgcagaagccggctggccgtggtgggggcagcgtaggcgtagcatccctctcctctcacttagcctgttgactcttgttattatcatgatattcacaaaacgccgcatgtttaaaaagtcatagatgtcatcttctctctgcccccagggaggaaagccaccttctcttgccccttggcccctttgtcaggggccaggggtctgccgggtgggggtgccaacaggcctggccctttcctcccctgcatccagccatgggggcctctgcgattgccggaaggttgcatggctggtcccagggccagcacaggcccgaggccgggctgcctggttttatttttatttaactttattttctgttttatgagtgtgtgtccgcccacccccacccccttcagtgttaagtggggagccctgggggagtctctcctgcctcccagcctctcccaagacctcccccctcgtcaccagccatccctctggaccaggcagagggcggaccgggtgggcaggggcctgagggtggctcgggccagcccaccagccaatggacccctcctcaggccgccagtgtcgccctgcccctttttaaaacaaaatgccctcgtttgtaaacccttagacgcttgagaataaaccccttccttttcttcca

SEQ ID NO: 376266 - DNA, 1420 bp, Homo sapiens
taccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttctggcctgagcctgggcccagccacctcgtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggcggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacaaaacaaaaaacaagaaaaaaaaaacacaaaaccccgtaaaatcacaaagaaaatccaacaccaaaggcgcagaagccggctggccgtggtgggggcagcgtaggcgtagcatccctctcctctcacttagcctgttgactcttgttattatcatgatattcacaaaacgccgcatgtttaaaaagtcatagatgtcatcttctctctgcccccagggaggaaagccaccttctcttgccccttggcccctttgtcaggggccaggggtctgccgggtgggggtgccaacaggcctggccctttcctcccctgcatccagccatgggggcctctgcgattgccggaaggttgcatggctggtcccagggccagcacaggcccgaggccgggctgcctggttttatttttatttaactttattttctgttttatgagtgtgtgtccgcccacccccacccccttcagtgttaagtggggagccctgggggagtctctcctgcctcccagcctctcccaagacctcccccctcgtcaccagccatccctctggaccaggcagagggcggaccgggtgggcaggggcctgagggtggctcgggccagcccaccagccaatggacccctcctcaggccgccagtgtcgccctgcccctttttaaaacaaaatgccctcgtttgtaaacccttagacgcttgagaataaaccccttccttttcttcca

SEQ ID NO: 376267 - DNA, 1149 bp, Homo sapiens
taccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttctggcctgagcctgggcccagccacctcctgacgggtcccctgggtctgcataggtctcccatggcgcaatgagtcagtggcccccagccaggcagtgtgggcattgccactgcggctggacggggctgcgcgctcgcgctctctctctctctctctctctctctttgatctcagggggtccttttgggagtttattgtattttattgtacttggtggggtgtttggggtgggggcggaggagagcttgttctcgtggggttgtcggtaccttcagaaacttttaccaaagtcacgattagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggcggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaaga

SEQ ID NO: 376268 - DNA, 597 bp, Homo sapiens
  misc_feature (493)..(493): n is a, c, g, or t
taccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttcctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagcttttcccagggggggggaantaggcttgagataaagggttgtaagtaagttttttaaataggtatttttgttctgagttggggtaattataaacaggttgttataaagatggttgttttttgaa

SEQ ID NO: 376269 - DNA, 2164 bp, Homo sapiens
taccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttctggcctgagcctgggcccagccacctcctgacgggtcccctgggtctgcataggtctcccatggcgcaatgagtcagtggcccccagccaggcagtgtgggcattgccactgcggctggacggggctgcgcgctcgcgctctctctctctctctctctctctctttgatctcagggggtccttttgggagtttattgtattttattgtacttggtggggtgtttggggtgggggcggaggagagcttgttctcgtggggttgtcggtaccttcagaaacttttaccaaagtcacgattagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggcggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacaaaacaaaaaacaagaaaaaaaaaacacaaaaccccgtaaaatcacaaagaaaatccaacaccaaaggcgcagaagccggctggccgtggtgggggcagcgtaggcgtagcatccctctcctctcacttagcctgttgactcttgttattatcatgatattcacaaaacgccgcatgtttaaaaagtcatagatgtcatcttctctctgcccccagggaggaaagccaccttctcttgccccttggcccctttgtcaggggccaggggtctgccgggtgggggtgccaacaggcctggccctttcctcccctgcatccagccatgggggcctctgcgattgccggaaggttgcatggctggtcccagggccagcacaggcccgaggccgggctgcctggttttatttttatttaactttattttctgttttatgagtgtgtgtccgcccacccccacccccttcagtgttaagtggggagccctgggggagtctctcctgcctcccagcctctcccaagacctcccccctcgtcaccagccatccctctggaccaggcagagggcggaccgggtgggcaggggcctgagggtggctcgggccagcccaccagccaatggacccctcctcaggccgccagtgtcgccctgcccctttttaaaacaaaatgccctcgtttgtaaacccttagacgcttgagaataaaccccttccttttcttccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaattaaaaatataatgggataaaataaaattttattagtaaaaatttaaaaaacattttggctgtttaaacgcggattccctgtaaatacccggctgttaccaacattaacctttgcaaaacccctgccgttcccatcgtcttggggtttaccg

SEQ ID NO: 376270 - DNA, 471 bp, Homo sapiens
gcccagtgaattagtaacagtgcttgaggcattcctcctccagggatcttttatgaaagctttaactcatgctccattttcagagagaactggcaggtacaactctcaagccctaaattttctccagaacttggaccctacatatatatatataaaaaaatataaatatataaaaatatataaaaggccgggcgcggtggctcacgcctgtaatcccagcactttgggaggctgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaa

SEQ ID NO: 376271 - DNA, 315 bp, Homo sapiens
tgaaggtgcctccatctctcccttccccaatatacctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376272 - DNA, 718 bp, Homo sapiens
taggcaaggagaaggcgggatgaaatacggacgaggggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagaacggccagggattacctcagacacccccagaaggcactcaccccacagactgaccccaagagatcactactacagtccgttccgagcacaagcaccaccaaaaacatcaagggacaatgcacaccaagacaacaccaacccgtgcaacggacaaggagcagggcaaccaagagacacacaaacgaaaaggaaagcacagcaccgcacaccggcacagatcccgccacaaccgcgacaggccgcaaccagggcaacagagcacgacccccaccccagcgcccccaggccgcgggaaggaaaaagagaaaccaaagacaagcacgcagcaacagcccgcaccacagcggcccgcaccagcccctcgacaacacgacaacacaaa

SEQ ID NO: 376273 - DNA, 3084 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaactagccctatggtctgtgcctgctggggctccccgcgcccacctgtctgggtcttggggggctggctgggcacaggcaggcatggtgacgggtgcctggaagggggagaggagtctgtgagtccctgcagattgaggcttccggtgtctcctcccccagtgtgtcatttccaggcagtggaccccagcccaacgttacaaggactgcttctccccggcccccaccatcatcaccacagtctgttttggctatacttccccccccaccagccttgtaattggctaattactggagatgaatgttggtaaacagaagccttcttctcttctgccatctgcttctccattatttgcccattgtacaccccccttttcctcccactgaagccccagttagtcagcagggcctagagtccctgtccccttttgagtacagccaagtgggggattccccagctcttaagtattgggggaggaaccaggggacccagagaggcacaccttgagaggacgcagatctcttcaggggtactgccaggtagcaggctttattgggaagggacaaagcctcaggagctgggtgccccagaggctgctgggtcttgagccacagctgcagccaatgcagcagctcgcgcctccttcttccgtttctgtttttcctccttgaggcgcttgcgctccttcttctctaggtcctggagcagctcctggaagcgggcactccttgggtccacctggtagcccaggagctcctgggcctcagcctgcagtcgggccctcctctccttgtcagcctgggccttctcccagttctcccgctgctgctgctgccagttcacaatcatctgtggcatcttggccatgcactctgcgatgtgctgctccctctcccgacgcttctgctcttcggccagtaactgacccgagtctcgggctgggcagaggaaagcagtgtggggtt

SEQ ID NO: 376274 - DNA, 2943 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaactaaaaaaaaaaaaaaaaaaaaaaaaaaaaaacacaaaacaaaaaaaaaaaaaaaaaacaacaaaaacaaaaaaaaaaataaaaaacaaaaaacaacaaaaaaaacacacaaaacaaaaaaaaaaaacaaaaacacacaaaaaagggggggggcacggaacaacgatctcaaccaagggggcaacaagaaaaaaacgaccacacagacaagagaagaaagggggaccacaacgcggagacgaagaaaaaaagaggagcaccacgagcaccaaaacaggcgggagaaaggagaaacacaccacagggaacaagatgatagaagaagcgcaaaacacacaggaaggcgggggcaacacagaaagggcaaaaaaccaccaaccagagaacacgagccggagacacaaaacacaggaggcggagcacagaggcgaacaccaacaggacgtagcacactcgcgcggaacaagaaaaaggacagacgacgagaaacaagaaaacacctcccccccgggggaaacaagcaaagcagcacggacagcaaaaagaaacaaagacaaaggagccagcaggcaacgatgaaacagatagaactggagagacgaatagaatgtaaaagtaaggagacaaataagacggcgcagagacaggaagaccacatcagagaacaacacagcacaagcagcagccagagaccaagaaggggaaaaagcggcgccgaaaaaaggctggccactaaaagcacaggacgcacccacacaacaccaccgaacacgaaccaaggcacaacgcaggccagcacagacagaccacagcgacaacaga

SEQ ID NO: 376275 - DNA, 2045 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376276 - DNA, 2030 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376277 - DNA, 1354 bp, Homo sapiens
ttcaggtagcagcgggcgagaggaagagggaacagagcctgacacagactctggggacgtcgtgggggcggattcctctgatgggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376278 - DNA, 2580 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccacccagaacagaaccgtgtctctgataaaggttttgaagtgaataaagttttaaaaactagccctatggtctgtgcctgctggggctccccgcgcccacctgtctgggtcttggggggctggctgggcacaggcaggcatggtgacgggtgcctggaagggggagaggagtctgtgagtccctgcagattgaggcttccggtgtctcctcccccagtgtgtcatttccaggcagtggaccccagcccaacgttacaaggactgcttctccccggcccccaccatcatcaccacagtctgttttggctatacttccccccccaccagccttgtaattggctaattactggagatgaatgttggtaaacagaagccttcttctcttctgccatctgcttctccattatttgcccattgtacaccccccttttcctcccactgaagccccagttagtcagcagggcctagagtccctgtccccttttgagtacagccaagtgggggattccccagctcttaagtattgggggaggaaccaggggacccagagaggcacaccttgagaggacgcagatctcttcaggggtactgccaggtagcaggctttattgggaagggacaaagcctcaggagctgggtgccccagaggctgctgggtcttgagccacagctgcagccaatgcagcagctcgcgcctccttcttccgtttctgtttttcctccttgaggcgcttgcgctccttcttctctaggtcctggagcagctcctggaagcgggcactccttgggtccacctggtagcccaggagctcctgggcctcagcctgcagtcgggccctcctctccttgtcagcctgggccttctcccagttctcccgctgctgctgctgccagttcacaatcatctgtggcatcttggccatgcactctgcgatgtgctgctccctctcccgacgcttctgctcttcggccagtaactgacccgagtctcgggctgggcagaggaaagcagtgtggggtt

SEQ ID NO: 376279 - DNA, 1620 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccacccagaacagaaccgtgtctctgataaaggttttgaagtgaataaagttttaaaaacta

SEQ ID NO: 376280 - DNA, 1321 bp, Homo sapiens
atgcagtggcgggatctctgctcactgcaagctccgcctcccgggttcaggccattctcctgcctcagcctcctgagtagctgggactacaggcgcccgccaccacgcccagctaattttttgtatttttagtagagacagggtttcatcatgtgttggccaggctggactcgaactcctgacctcaagtgatccacctgcctctgcctcccaaagtgctgggattacaggtgtgagccaccgtgcccggcttatttcttggctcacttaaaagcacatcatcagctcttccagggtagggcttgtgtcgactgctatgttgtgtttggccagaacaggctcctctggatatttgcctgactgaatgaaaaagcaagggctgtgatgacctggggagaggaggggaccagggctgtgaattaccttcccttccccaccctctcctgcagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376281 - DNA, 916 bp, Homo sapiens
gctcagatgtggagggggaggtgggcgccagctccccaggggctcgttcagcatctgggatgtccgccagctccccaggggctcgttcagcatctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376282 - DNA, 1309 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcagaacagaaccgtgtctctgataaaggttttgaagtgaataaagttttaaaaacta

SEQ ID NO: 376283 - DNA, 1403 bp, Homo sapiens
atgcagtggcgggatctctgctcactgcaagctccgcctcccgggttcaggccattctcctgcctcagcctcctgagtagctgggactacaggcgcccgccaccacgcccagctaattttttgtatttttagtagagacagggtttcatcatgtgttggccaggctggactcgaactcctgacctcaagtgatccacctgcctctgcctcccaaagtgctgggattacaggtgtgagccaccgtgcccggcttatttcttggctcacttaaaagcacatcatcagctcttccagggtagggcttgtgtcgactgctatgttgtgtttggccagaacaggctcctctggatatttgcctgactgaatgaaaaagcaagggctgtgatgacctggggagaggaggggaccagggctgtgaattaccttcccttccccaccctctcctgcagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagagggtaagaggcctggctgaggggtgactgcaggtgggcaggacccctaccctctcctgctcacacttaacctatcttcccacagttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376284 - DNA, 2207 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaactaaaaaaaaaaaaaaaaaaaaaaaaaaaaaacacaaaacaaaaaaaaaaaaaaaaaacaacaaaaacaaaaaaaaaaataaaaaacaaaaaacaacaaaaaaaacacacaaaacaaaaaaaaaaaacaaaaacacacaaaaaagggggggggcacggaacaacgatctcaaccaagggggcaacaagaaaaaaacgaccacacagacaagagaagaaagggggaccacaacgcggagacgaagaaaaaaagaggagcaccacgagcaccaaaacaggcgggagaaaggagaaacacaccacagggaacaagatgatagaagaagcgcaaaacacacaggaaggcgggggcaacacagaaagggcaaaaaaccaccaaccagagaacacgagccggagacacaaaacacaggaggcggagcacagaggcgaacaccaacaggacgtagcacactcgcgcggaacaagaaaaaggacagacgacgagaaacaagaaaacacctcccccccgggggaaacaagcaaagcagcacggacagcaaaaagaaacaaagacaaaggagccagcaggcaacgatgaaacagatagaactggagagacgaatagaatgtaaaagtaaggagacaaataagacggcgcagagacaggaagaccacatcagagaacaacacagcacaagcagcagccagagaccaagaaggggaaaaagcggcgccgaaaaaaggctggccactaaaagcacaggacgcacccacacaacaccaccgaacacgaaccaaggcacaacgcaggccagcacagacagaccacagcgacaacaga

SEQ ID NO: 376285 - DNA, 612 bp, Homo sapiens
gctcccatgggacgcaggacactgtgaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376286 - DNA, 1185 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgacccgcagatgaactacatccaggtgacgccgcaggagaaagaagctatagagaggttgaaggccctgggcttcccagagagcctggtcatccaggcctatttcgcgtgtgcagaacagaaccgtgtctctgataaaggttttgaagtgaataaagttttaaaaacta

SEQ ID NO: 376287 - DNA, 1364 bp, Homo sapiens
  misc_feature (1233)..(1234): n is a, c, g, or t
  misc_feature (1236)..(1236): n is a, c, g, or t
  misc_feature (1241)..(1241): n is a, c, g, or t
  misc_feature (1250)..(1251): n is a, c, g, or t
  misc_feature (1269)..(1269): n is a, c, g, or t
  misc_feature (1276)..(1276): n is a, c, g, or t
  misc_feature (1285)..(1286): n is a, c, g, or t
  misc_feature (1293)..(1293): n is a, c, g, or t
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagagggtganngncctgngttccaganngctgggcatcaggctaancgcgggngaacaatgnnaactggntgcaattccccggagtcagaattgatgacatgatgcaggagcaggcctgaaacccaactacttatccgaag

SEQ ID NO: 376288 - DNA, 458 bp, Homo sapiens
  misc_feature (38)..(38): n is a, c, g, or t
cgccggcagagctccaccgctgaggccaacgaggccanggctttattgggaagggacaaagcctcaggagctgggtgccccagaggctgctgggtcttgagccacagctgcagccaatgcagcagctcgcgcctccttcttccgtttctgtttttcctccttgaggcgcttgcgctccttcttctctaggtcctggagcagctcctggaagcgggcactccttgggtccacctggtagcccaggagctcctgggcctcagcctgcagtcgggccctcctctccttgtcagcctgggccttctcccagttctcccgctgctgctgctgccagttcacaatcatctgtggcatcttggccatgcactctgcgatgtgctgctccctctcccgacgcttctgctcttcggccagtaactgacccgagtctcgggctgggcagaggaaagcagtgtggggtt

SEQ ID NO: 376289 - DNA, 2124 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376290 - DNA, 1773 bp, Homo sapiens
ggctggtaccggtccggagatggttaggatggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376291 - DNA, 2390 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacggtgaggtggggcttccgcctcccggggaggccttgagggagtacccgggcgtcactgccctgatgggcggttgggaaggcaaaacctgccctgaaaagcctttgggtagtgattctagccactaaaggcttcccacaggaggctggatgtgagtgatgggtgggcctctggagggcagggccgaggcctcatctgtgtcctgccagggcatggaggagggtggcagcaggaggtctgtgcattagaactaaacaggacccctgacaggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376292 - DNA, 1674 bp, Homo sapiens
gacccccatgcctcaggatactcctcaatagccatcgctgtagtatatccaaagacaaccagtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376293 - DNA, 1624 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttattta

SEQ ID NO: 376294 - DNA, 1780 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgacccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376295 - DNA, 1109 bp, Homo sapiens
gcacaccacgacgtgcgtattgtcggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376296 - DNA, 1694 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376297 - DNA, 1388 bp, Homo sapiens
ttctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376298 - DNA, 1048 bp, Homo sapiens
gcaaattaggctaggtagaggccgcgggttaattcggccgaggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 376299 - DNA, 431 bp, Homo sapiens
acttccggcgacgggccccctccgcgcgtactgcgggccccacgggtgttagtggcgggggcggcagagtccgggtgggttgtcgcgacggagccgggcctcttcgccgtcttgagacggggctggcgagaagggcccctcacggagttgccatgggcgtctaaccgcggcagccaggcccctctctacgtgagaccccggcccccctcccctttctgcagcccgcccgccacctgcgcgccgcgtggcctccgccggcgcctgcccgccccgcgcctccgtctcccacggtaagaggcggtgagggccgcgtcgcctctccctggaggactcgtcgtgaggtgtcggcgagcccctccgcccaccgccccgccccaggccagcgctccattggcgacagaggcgggcacggccgccctcgggcccgagag

SEQ ID NO: 376300 - DNA, 2232 bp, Homo sapiens
acttccggcgacgggccccctccgcgcgtactgcgggccccacgggtgttagtggcgggggcggcagagtccgggtgggttgtcgcgacggagccgggcctcttcgccgtcttgagacggggctggcgagaagggcccctcacggagttgccatgggcgtctaaccgcggcagccaggcccctctctacgtgagaccccggcccccctcccctttctgcagcccgcccgccacctgcgcgccgcgtggcctccgccggcgcctgcccgccccgcgcctccgtctcccacggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctg

SEQ ID NO: 376301 - DNA, 2333 bp, Homo sapiens
acttccggcgacgggccccctccgcgcgtactgcgggccccacgggtgttagtggcgggggcggcagagtccgggtgggttgtcgcgacggagccgggcctcttcgccgtcttgagacggggctggcgagaagggcccctcacggagttgccatgggcgtctaaccgcggcagccaggcccctctctacgtgagaccccggcccccctcccctttctgcagcccgcccgccacctgcgcgccgcgtggcctccgccggcgcctgcccgccccgcgcctccgtctcccacggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcgggtaaaagacgagttcagtgacctttctgagggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagaggtgatgcctgcaacgcgaggctcgccctgcctgtcggggccggggctccatgcatgctcttcattgcagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctg

SEQ ID NO: 376302 - DNA, 2697 bp, Homo sapiens
acttccggcgacgggccccctccgcgcgtactgcgggccccacgggtgttagtggcgggggcggcagagtccgggtgggttgtcgcgacggagccgggcctcttcgccgtcttgagacggggctggcgagaagggcccctcacggagttgccatgggcgtctaaccgcggcagccaggcccctctctacgtgagaccccggcccccctcccctttctgcagcccgcccgccacctgcgcgccgcgtggcctccgccggcgcctgcccgccccgcgcctccgtctcccacggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcgggtaaaagacgagttcagtgacctttctgagggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagaggtgatgcctgcaacgcgaggctcgccctgcctgtcggggccggggctccatgcatgctcttcattgcagggaggagcttcccaccatctacaagtgtccttaccagggctgcacggccgtgtaccgaggcgctgacggcatgaaggtgagcactggctgtgcctgacccaggcccggcagctgtcagtgtgaacctgggggaggtagcaggtgtttctgcagcctaactcagacttgcgcccaaggacactttgacctaggttaaccgagacctgaagcagtcctagccagtgccatccttgggggtagatgtgaggccagactttcacttgagacaccccccgggggggtctagaagtttcttggagtgaagctgtgaaggagccagtggtgtcgctggaggaggagttggatctgccttccaggggcctcagctgtcacctactgagggctcgtgccatgtggcccgggtgcggctctgagggtctctcaccgagtctctccttcagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctg

SEQ ID NO: 376303 - DNA, 1512 bp, Homo sapiens
tggagagacaaaaaacattttgcaaatggagatcagaaaccattgaatttgggaacctctttttttcagagtctctggtaagaagagtgaaagcaaagaagccaagaagtctgaagaaccaagaattcggaagaagccgggacccaagcccggatggaagaagaagcttcgttgtgagaggtgatgcctgcaacgcgaggctcgccctgcctgtcggggccggggctccatgcatgctcttcattgcagggaggagcttcccaccatctacaagtgtccttaccagggctgcacggccgtgtaccgaggcgctgacggcatgaaggtgagcactggctgtgcctgacccaggcccggcagctgtcagtgtgaacctgggggaggtagcaggtgtttctgcagcctaactcagacttgcgcccaaggacactttgacctaggttaaccgagacctgaagcagtcctagccagtgccatccttgggggtagatgtgaggccagactttcacttgagacaccccccgggggggtctagaagtttcttggagtgaagctgtgaaggagccagtggtgtcgctggaggaggagttggatctgccttccaggggcctcagctgtcacctactgagggctcgtgccatgtggcccgggtgcggctctgagggtctctcaccgagtctctccttcagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctg

SEQ ID NO: 376304 - DNA, 800 bp, Homo sapiens
gtcttcccagctgtgatggtttcacattgtcatcgtcgtccccccgggaggttggagcatcaggggcctggactcactggactctcccctctcagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctg

SEQ ID NO: 376305 - DNA, 240 bp, Homo sapiens
tccgtttgtctgcaagagctgccacgcccagttctaccagtgccacagccttctcaagtccttcctgcagagggtcaacgcctccccggctggtcgccggaagccttgtgcaaagtacgccctagtctgttcagagcacgttcaggctgtcagtactgcagtgtgacgggtgttgagagagggacagggcgtgcctccgcgggagcctctgggtggggggaatgggccatgcccgggttc

SEQ ID NO: 376306 - DNA, 2216 bp, Homo sapiens
  misc_feature (1)..(1): n is a, c, g, or t
nacgccgggtcctctaggaacctcgggccgggcagcacccgcgggattctgctggcgtcctccgctgccatgaagcgggaccggctgggccgcttcctgtctcctgggtcgtcccgacagtgcggggcctcggacggcggcggcggcgtcagccggactcggggccgcccttcccttagcggtgggccgagggtggacggggcgacggcgcggcgcgcctggggcccggtggggtcctgcggggacgcgggcgaggacggcgcggacgaggcaggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctg

SEQ ID NO: 376307 - DNA, 2264 bp, Homo sapiens
acttccggcgacgggccccctccgcgcgtactgcgggccccacgggtgttagtggcgggggcggcagagtccgggtgggttgtcgcgacggagccgggcctcttcgccgtcttgagacggggctggcgagaagggcccctcacggagttgccatgggcgtctaaccgcggcagccaggcccctctctacgtgagaccccggcccccctcccctttctgcagcccgcccgccacctgcgcgccgcgtggcctccgccggcgcctgcccgccccgcgcctccgtctcccacggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcgggtaaaagacgagttcagtgacctttctgagggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctg

SEQ ID NO: 376308 - DNA, 2213 bp, Homo sapiens
acttccggcgacgggccccctccgcgcgtactgcgggccccacgggtgttagtggcgggggcggcagagtccgggtgggttgtcgcgacggagccgggcctcttcgccgtcttgagacggggctggcgagaagggcccctcacggagttgccatgggcgtctaaccgcggcagccaggcccctctctacgtgagaccccggcccccctcccctttctgcagcccgcccgccacctgcgcgccgcgtggcctccgccggcgcctgcccgccccgcgcctccgtctcccacggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctg

SEQ ID NO: 376309 - DNA, 2302 bp, Homo sapiens
acttccggcgacgggccccctccgcgcgtactgcgggccccacgggtgttagtggcgggggcggcagagtccgggtgggttgtcgcgacggagccgggcctcttcgccgtcttgagacggggctggcgagaagggcccctcacggagttgccatgggcgtctaaccgcggcagccaggcccctctctacgtgagaccccggcccccctcccctttctgcagcccgcccgccacctgcgcgccgcgtggcctccgccggcgcctgcccgccccgcgcctccgtctcccacggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtaagtgtgagtcaggaccccctcccagggctgtggccctcgcaccttcttatctgcctctgtcccccaggtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctg

SEQ ID NO: 376310 - DNA, 1209 bp, Homo sapiens
tgggtatggtgagagtcaggatcttatttaaatcttctgttatagcagaccttttgtagacactgttccccactgtggtgggggaaggggagggcaccaccttgttattgccagcagaggtggaagtccttctcccactcaagtatccaccgttactgggattaggggaaggggctgatgcattacctcccagagagaaggacattttggattccctcttgggccttcgctgaaacctctgtgatggggttgggtgctagggcccattacagcctggtgagggtggggtcacagtgttttctctggtatttgcctgtagtagagcagtttttgtctaaaagttttttgtcttgataggctacctctttcctggtcttttggtagagagcagcttttgtcaggcttttgttatcaaatacacctcttaaagttttggggttgctggttcttctgctccaggtctgcaatatttgaagcaaaaaagaaattccagggaactccctggtgtgttttgccttgagacctccctagctggtgtgccttattctctccacctttcagagttgtcttatgattgttttgcatataatgtctaggatttttagttgtacttattgggggaatagggaagaatatgtgtactccgctttcacaaagcactcatatatagatctagtttctcaaatagctaaagaactaaaagtgtaccagcagttctgaggctcagcagtatagcccaagaactatgaactcagggatgatagaagtgaaataccatcacatggtgaggtcaagggatatctgtaggcacctacttcacagggtccatgctgaaagactgcaaccaatacacagcgcttatctgggggcatacactggaccgatatagtttcacaatcaaaatatttcccaacaaaatgtgcactgttattctggtccccagtcagctgcacctggcctgagttttttagtcaggaaaaatttctcaaagatgattctgtttttcctccataaatactatagggcaattgcccaaaagccaggccataaatggcaagagccacgtgcttcacctaggcccaagtggttgctgtgccctcagtgttgacagactaacaggagggaatgggtgttcaggcttaactaagccactactaccatcaccaccctccaggttaaaaaaaaaaaaaaaaaaaagccagatttgct

SEQ ID NO: 376311 - DNA, 436 bp, Homo sapiens
tgcaaataattgaatgagggtgtattataggggaaaatatatgtattacttggaattttgctgcttatttatggttttgtttttattctgtgtactttattggtgaactgtcttttcctctcatactctacacttggctacagatgacagagctttggtagttagacaattgcagtacaggattatgtgagtgttggttagggctcaattagcttattatgtttggcgatcagtatgtatgagctgaagggcatgctctagcagtgaggagctctgcgctgtgggagacccctcattaatgttctgtaaacttaggattggattcagtgatctctgaagtttcttttagttcttgagattctatgagatatcaggatcttgtgatcttaaaatttataggacaatttagttaataattgggttagtaattaggtga

SEQ ID NO: 376312 - DNA, 2440 bp, Homo sapiens
tctaggaagtccccaagagcacaggagcccagagacctcgcaggaggaagcagcagtatctgtgttccaaatcctgcccagcccccaggcagccatggtatcttctcagctggctcgagggcacacctcccaaaatgcagagaaggcagggtggctaggaatggctctagtagaattctccccttatcttgtctggaaacaaggggcaaagagctatctatttcctcctgccagcctcctgcccccaacaggattcctcacatcccaggaccagctggaaaaggtggtgagagttggaaagagactgctcagtgaggactgccctgcgaaccagcttggattcatcccgttcacctccacgttctgcactcggggccgagggaagggaggcagcccaggcagctagagaacttgatgaaacacactcaatctgaatctcgcttgatcgtcatgctgacccagtgaggccactcctcgacttttcagctcccgcacgattcctgaagcaggaaaagaaacagttctgtgagtctactcagggtcaggcatcctttccgactactcactcagcagcggatccccacccgcctctgactcccagtgtctttcggctccaacgtaagttcaccgaacgtctaagagctgaggattcaaaggcatgtaagaccgcccctgccctcagctgcaagacctgtccgcgatcctacgagccccattccgccctctttccccgaccttggtcccccatgggccctacaaccaggtccccgactgacaccttgaccagcgaacacagcaaacaggcccgcagatgccgcaggtccttcggcaccgtctccagggccatcttcgccgatgggaagaacaacagggagatagacgaccacagcctgtgcacccgcaggaagtaaatagctcgttacccagaatgcccaccacttccggcgcttagacttcctcttccggtgtgggcggacgccagctccgcccctacccccgccagaggagatggtttctcccgccagcaggcggggaggctgggcggccggccgccacctgggccggagcgcgtcgcagccacctgagcccgccgagggcgcggcggaggctgtgtggggtagtcagcgggcccccggggcgggggggcggctgcgcttgcgcgggagtgtgtcgggctgagccgcagcgccgagacgcgggctgtttgatctgggctggtggccctgggcgtcggtcctgttccccgatggtaacccgaagtttgtttttttttgttttgtctccccgttttagaagcattgggggcagtgaatccactgtctccctctggattgtctctgcagagaccgagaagaaatccagggacagccccacccctccttcctaactgcgagagcgctatagggtttccacttgcttcccacaggaatgctggcctgggagctacggcggaaaaaaatgcgtatttatcttttaaaactccgtctgtttgctcgttccggctgataatttatactttgcgcagttcttagcgcttagacacggttcctttactaaagaccatttgtaggagattaggtgtcctttttttccctttcatttcaccgtctaggaagcgaaatgccttgttctataggcactaaaccaccacccctaccaaacctttctcggggaagcagaaggggaacttgtgccttgtgaggaagcgacaaaggccccttctggccctggagacttcacgccaatggagcaccagctctctgtcctcgcaatagcccgagtgcaggcagaacgcagtcatttgtgtttatctgagaggagctttgggatataaatagtttcaggccccgctgcgctgtcattccagcccagcctcctgattgagctgcttccgggcgggctttcttcttgttggcggtcccatgctgtgttcagatgggctctgtgacaggtttggatgttttctatcactgaataaaactttccactttggaacatattttctacactctattatctcatgtaagtcctgcaacaactattaagtaggcccattttatggactgaaaaagcgaggcacagagtatttgcccaaggtctgagtcactgaagtatgataatgtgtgaagtgaacagtataataataatgactgaagcacagtaagaatccagtcatgctttctccttccctgatctcactaagccacacttttaggggcttacaaaccagttcttattgccaagccctctactctaccctatcctttcatgaatcggagcctagcctctgataacataaataatttacttctcttgatgtagaaagagatgacgttgttaccctgagtgacagtcacgacagaacaaaaccacaagaccagaccacatttgtggataaatatattagcaaataaatatatttcttaacataatgcctgat

SEQ ID NO: 376313 - DNA, 2376 bp, Homo sapiens
tctaggaagtccccaagagcacaggagcccagagacctcgcaggaggaagcagcagtatctgtgttccaaatcctgcccagcccccaggcagccatggtatcttctcagctggctcgagggcacacctcccaaaatgcagagaaggcagggtggctaggaatggctctagtagaattctccccttatcttgtctggaaacaaggggcaaagagctatctatttcctcctgccagcctcctgcccccaacaggattcctcacatcccaggaccagctggaaaaggtggtgagagttggaaagagactgctcagtgaggactgccctgcgaaccagcttggattcatcccgttcacctccacgttctgcactcggggccgagggaagggaggcagcccaggcagctagagaacttgatgaaacacactcaatctgaatctcgcttgatcgtcatgctgacccagtgagtctactcagggtcaggcatcctttccgactactcactcagcagcggatccccacccgcctctgactcccagtgtctttcggctccaacgtaagttcaccgaacgtctaagagctgaggattcaaaggcatgtaagaccgcccctgccctcagctgcaagacctgtccgcgatcctacgagccccattccgccctctttccccgaccttggtcccccatgggccctacaaccaggtccccgactgacaccttgaccagcgaacacagcaaacaggcccgcagatgccgcaggtccttcggcaccgtctccagggccatcttcgccgatgggaagaacaacagggagatagacgaccacagcctgtgcacccgcaggaagtaaatagctcgttacccagaatgcccaccacttccggcgcttagacttcctcttccggtgtgggcggacgccagctccgcccctacccccgccagaggagatggtttctcccgccagcaggcggggaggctgggcggccggccgccacctgggccggagcgcgtcgcagccacctgagcccgccgagggcgcggcggaggctgtgtggggtagtcagcgggcccccggggcgggggggcggctgcgcttgcgcgggagtgtgtcgggctgagccgcagcgccgagacgcgggctgtttgatctgggctggtggccctgggcgtcggtcctgttccccgatggtaacccgaagtttgtttttttttgttttgtctccccgttttagaagcattgggggcagtgaatccactgtctccctctggattgtctctgcagagaccgagaagaaatccagggacagccccacccctccttcctaactgcgagagcgctatagggtttccacttgcttcccacaggaatgctggcctgggagctacggcggaaaaaaatgcgtatttatcttttaaaactccgtctgtttgctcgttccggctgataatttatactttgcgcagttcttagcgcttagacacggttcctttactaaagaccatttgtaggagattaggtgtcctttttttccctttcatttcaccgtctaggaagcgaaatgccttgttctataggcactaaaccaccacccctaccaaacctttctcggggaagcagaaggggaacttgtgccttgtgaggaagcgacaaaggccccttctggccctggagacttcacgccaatggagcaccagctctctgtcctcgcaatagcccgagtgcaggcagaacgcagtcatttgtgtttatctgagaggagctttgggatataaatagtttcaggccccgctgcgctgtcattccagcccagcctcctgattgagctgcttccgggcgggctttcttcttgttggcggtcccatgctgtgttcagatgggctctgtgacaggtttggatgttttctatcactgaataaaactttccactttggaacatattttctacactctattatctcatgtaagtcctgcaacaactattaagtaggcccattttatggactgaaaaagcgaggcacagagtatttgcccaaggtctgagtcactgaagtatgataatgtgtgaagtgaacagtataataataatgactgaagcacagtaagaatccagtcatgctttctccttccctgatctcactaagccacacttttaggggcttacaaaccagttcttattgccaagccctctactctaccctatcctttcatgaatcggagcctagcctctgataacataaataatttacttctcttgatgtagaaagagatgacgttgttaccctgagtgacagtcacgacagaacaaaaccacaagaccagaccacatttgtggataaatatattagcaaataaatatatttcttaacataatgcctgat

SEQ ID NO: 376314 - DNA, 2202 bp, Homo sapiens
actgaaccctagagcccctgactgtgggctccacccaggcaagagccaatggaactggagcctcctgcccccaacaggattcctcacatcccaggaccagctggaaaaggtggtgagagttggaaagagactgctcagtgaggactgccctgcgaaccagcttggattcatcccgttcacctccacgttctgcactcggggccgagggaagggaggcagcccaggcagctagagaacttgatgaaacacactcaatctgaatctcgcttgatcgtcatgctgacccagtgagtctactcagggtcaggcatcctttccgactactcactcagcagcggatccccacccgcctctgactcccagtgtctttcggctccaacgtaagttcaccgaacgtctaagagctgaggattcaaaggcatgtaagaccgcccctgccctcagctgcaagacctgtccgcgatcctacgagccccattccgccctctttccccgaccttggtcccccatgggccctacaaccaggtccccgactgacaccttgaccagcgaacacagcaaacaggcccgcagatgccgcaggtccttcggcaccgtctccagggccatcttcgccgatgggaagaacaacagggagatagacgaccacagcctgtgcacccgcaggaagtaaatagctcgttacccagaatgcccaccacttccggcgcttagacttcctcttccggtgtgggcggacgccagctccgcccctacccccgccagaggagatggtttctcccgccagcaggcggggaggctgggcggccggccgccacctgggccggagcgcgtcgcagccacctgagcccgccgagggcgcggcggaggctgtgtggggtagtcagcgggcccccggggcgggggggcggctgcgcttgcgcgggagtgtgtcgggctgagccgcagcgccgagacgcgggctgtttgatctgggctggtggccctgggcgtcggtcctgttccccgatggtaacccgaagtttgtttttttttgttttgtctccccgttttagaagcattgggggcagtgaatccactgtctccctctggattgtctctgcagagaccgagaagaaatccagggacagccccacccctccttcctaactgcgagagcgctatagggtttccacttgcttcccacaggaatgctggcctgggagctacggcggaaaaaaatgcgtatttatcttttaaaactccgtctgtttgctcgttccggctgataatttatactttgcgcagttcttagcgcttagacacggttcctttactaaagaccatttgtaggagattaggtgtcctttttttccctttcatttcaccgtctaggaagcgaaatgccttgttctataggcactaaaccaccacccctaccaaacctttctcggggaagcagaaggggaacttgtgccttgtgaggaagcgacaaaggccccttctggccctggagacttcacgccaatggagcaccagctctctgtcctcgcaatagcccgagtgcaggcagaacgcagtcatttgtgtttatctgagaggagctttgggatataaatagtttcaggccccgctgcgctgtcattccagcccagcctcctgattgagctgcttccgggcgggctttcttcttgttggcggtcccatgctgtgttcagatgggctctgtgacaggtttggatgttttctatcactgaataaaactttccactttggaacatattttctacactctattatctcatgtaagtcctgcaacaactattaagtaggcccattttatggactgaaaaagcgaggcacagagtatttgcccaaggtctgagtcactgaagtatgataatgtgtgaagtgaacagtataataataatgactgaagcacagtaagaatccagtcatgctttctccttccctgatctcactaagccacacttttaggggcttacaaaccagttcttattgccaagccctctactctaccctatcctttcatgaatcggagcctagcctctgataacataaataatttacttctcttgatgtagaaagagatgacgttgttaccctgagtgacagtcacgacagaacaaaaccacaagaccagaccacatttgtggataaatatattagcaaataaatatatttcttaacataatgcctgat

SEQ ID NO: 376315 - DNA, 2239 bp, Homo sapiens
tctaggaagtccccaagagcacaggagcccagagacctcgcaggaggaagcagcagtatctgtgttccaaatcctgcccagcccccaggcagccatgcctcctgcccccaacaggattcctcacatcccaggaccagctggaaaaggtggtgagagttggaaagagactgctcagtgaggactgccctgcgaaccagcttggattcatcccgttcacctccacgttctgcactcggggccgagggaagggaggcagcccaggcagctagagaacttgatgaaacacactcaatctgaatctcgcttgatcgtcatgctgacccagtgagtctactcagggtcaggcatcctttccgactactcactcagcagcggatccccacccgcctctgactcccagtgtctttcggctccaacgtaagttcaccgaacgtctaagagctgaggattcaaaggcatgtaagaccgcccctgccctcagctgcaagacctgtccgcgatcctacgagccccattccgccctctttccccgaccttggtcccccatgggccctacaaccaggtccccgactgacaccttgaccagcgaacacagcaaacaggcccgcagatgccgcaggtccttcggcaccgtctccagggccatcttcgccgatgggaagaacaacagggagatagacgaccacagcctgtgcacccgcaggaagtaaatagctcgttacccagaatgcccaccacttccggcgcttagacttcctcttccggtgtgggcggacgccagctccgcccctacccccgccagaggagatggtttctcccgccagcaggcggggaggctgggcggccggccgccacctgggccggagcgcgtcgcagccacctgagcccgccgagggcgcggcggaggctgtgtggggtagtcagcgggcccccggggcgggggggcggctgcgcttgcgcgggagtgtgtcgggctgagccgcagcgccgagacgcgggctgtttgatctgggctggtggccctgggcgtcggtcctgttccccgatggtaacccgaagtttgtttttttttgttttgtctccccgttttagaagcattgggggcagtgaatccactgtctccctctggattgtctctgcagagaccgagaagaaatccagggacagccccacccctccttcctaactgcgagagcgctatagggtttccacttgcttcccacaggaatgctggcctgggagctacggcggaaaaaaatgcgtatttatcttttaaaactccgtctgtttgctcgttccggctgataatttatactttgcgcagttcttagcgcttagacacggttcctttactaaagaccatttgtaggagattaggtgtcctttttttccctttcatttcaccgtctaggaagcgaaatgccttgttctataggcactaaaccaccacccctaccaaacctttctcggggaagcagaaggggaacttgtgccttgtgaggaagcgacaaaggccccttctggccctggagacttcacgccaatggagcaccagctctctgtcctcgcaatagcccgagtgcaggcagaacgcagtcatttgtgtttatctgagaggagctttgggatataaatagtttcaggccccgctgcgctgtcattccagcccagcctcctgattgagctgcttccgggcgggctttcttcttgttggcggtcccatgctgtgttcagatgggctctgtgacaggtttggatgttttctatcactgaataaaactttccactttggaacatattttctacactctattatctcatgtaagtcctgcaacaactattaagtaggcccattttatggactgaaaaagcgaggcacagagtatttgcccaaggtctgagtcactgaagtatgataatgtgtgaagtgaacagtataataataatgactgaagcacagtaagaatccagtcatgctttctccttccctgatctcactaagccacacttttaggggcttacaaaccagttcttattgccaagccctctactctaccctatcctttcatgaatcggagcctagcctctgataacataaataatttacttctcttgatgtagaaagagatgacgttgttaccctgagtgacagtcacgacagaacaaaaccacaagaccagaccacatttgtggataaatatattagcaaataaatatatttcttaacataatgcctgat

SEQ ID NO: 376316 - DNA, 2185 bp, Homo sapiens
tctaggaagtccccaagagcacaggagcccagagacctcgcaggaggaagcagcagtatctgtgttccaaatcctgcccagcccccaggcagccatgcctcctgcccccaacaggattcctcacatcccaggaccagctggaacttggattcatcccgttcacctccacgttctgcactcggggccgagggaagggaggcagcccaggcagctagagaacttgatgaaacacactcaatctgaatctcgcttgatcgtcatgctgacccagtgagtctactcagggtcaggcatcctttccgactactcactcagcagcggatccccacccgcctctgactcccagtgtctttcggctccaacgtaagttcaccgaacgtctaagagctgaggattcaaaggcatgtaagaccgcccctgccctcagctgcaagacctgtccgcgatcctacgagccccattccgccctctttccccgaccttggtcccccatgggccctacaaccaggtccccgactgacaccttgaccagcgaacacagcaaacaggcccgcagatgccgcaggtccttcggcaccgtctccagggccatcttcgccgatgggaagaacaacagggagatagacgaccacagcctgtgcacccgcaggaagtaaatagctcgttacccagaatgcccaccacttccggcgcttagacttcctcttccggtgtgggcggacgccagctccgcccctacccccgccagaggagatggtttctcccgccagcaggcggggaggctgggcggccggccgccacctgggccggagcgcgtcgcagccacctgagcccgccgagggcgcggcggaggctgtgtggggtagtcagcgggcccccggggcgggggggcggctgcgcttgcgcgggagtgtgtcgggctgagccgcagcgccgagacgcgggctgtttgatctgggctggtggccctgggcgtcggtcctgttccccgatggtaacccgaagtttgtttttttttgttttgtctccccgttttagaagcattgggggcagtgaatccactgtctccctctggattgtctctgcagagaccgagaagaaatccagggacagccccacccctccttcctaactgcgagagcgctatagggtttccacttgcttcccacaggaatgctggcctgggagctacggcggaaaaaaatgcgtatttatcttttaaaactccgtctgtttgctcgttccggctgataatttatactttgcgcagttcttagcgcttagacacggttcctttactaaagaccatttgtaggagattaggtgtcctttttttccctttcatttcaccgtctaggaagcgaaatgccttgttctataggcactaaaccaccacccctaccaaacctttctcggggaagcagaaggggaacttgtgccttgtgaggaagcgacaaaggccccttctggccctggagacttcacgccaatggagcaccagctctctgtcctcgcaatagcccgagtgcaggcagaacgcagtcatttgtgtttatctgagaggagctttgggatataaatagtttcaggccccgctgcgctgtcattccagcccagcctcctgattgagctgcttccgggcgggctttcttcttgttggcggtcccatgctgtgttcagatgggctctgtgacaggtttggatgttttctatcactgaataaaactttccactttggaacatattttctacactctattatctcatgtaagtcctgcaacaactattaagtaggcccattttatggactgaaaaagcgaggcacagagtatttgcccaaggtctgagtcactgaagtatgataatgtgtgaagtgaacagtataataataatgactgaagcacagtaagaatccagtcatgctttctccttccctgatctcactaagccacacttttaggggcttacaaaccagttcttattgccaagccctctactctaccctatcctttcatgaatcggagcctagcctctgataacataaataatttacttctcttgatgtagaaagagatgacgttgttaccctgagtgacagtcacgacagaacaaaaccacaagaccagaccacatttgtggataaatatattagcaaataaatatatttcttaacataatgcctgat

SEQ ID NO: 376317 - DNA, 399 bp, Homo sapiens
caggaggtggagagcaaagatgctggcagccttgcatcttgctaggtctttatagctgtgtctctggatttgtaggccactcctcgacttttcagctcccgcacgattcctgaagcaggaaaagaaacagttctgtgaggtaagattcagaagggtaagataggccactcagctgccaccttgaggggggtactataagcaaactggagttcctagactacttatcaatcgtctgcttggccaggcacggtggctcatgcctgcaatctcagcactttgggaggtcaaggtggatcacttgaggtcaggagttcaagactagcctgggctacagagcaaggccccatctctacaaaaaaattttaaaaattagccaggtgtagtggcttgcacctgtag

SEQ ID NO: 376318 - DNA, 1029 bp, Homo sapiens
tctaggaagtccccaagagcacaggagcccagagacctcgcaggaggaagcagcagtatctgtgttccaaatcctgcccagcccccaggcagccatggtatcttctcagctggctcgagggcacacctcccaaaatgcagagaaggcagggtggctaggaatggctctagtagaattctccccttatcttgtctggaaacaaggggcaaagagctatctatttcctcctgccagcctcctgcccccaacaggattcctcacatcccaggaccagctggaaaaggtggtgagagttggaaagagactgctcagtgaggactgccctgcgaaccagcttggattcatcccgttcacctccacgttctgcactcggggccgagggaagggaggcagcccaggcagctagagaacttgatgaaacacactcaatctgaatctcgcttgatcgtcatgctgacccagtgagggttgtgaaaatctatggaggcacaatggttcagctattccaccttatccagagagttgaaactccaccacagagctctccaaagtggcacatggtgctgtgcagactccaccgctgctgccagtaccagtcctgtgcgtccaaagcctgcctgcagggtagccatcagcagccagggccagagggcagccagctgcagctggtggccaccactcatgctaccagctgcagcaatgcacttcaaccatacatactgcttccactagctaataccaaatgcaggttctcagatccagacaaatggaggaaaagaacatttatgcttccgtttcagaaagccaagtcgtagttttggcccttcctttctctaaagtttattcccaaaaacaggtagcattcctgattgggcagagaagaggatattttcagcccacatctgctgcaggtatgtcattttctcccatcttcactgtgactagtaaagatctcaccacttctctttggaatttccaactttgcttgtgattgaatgtcacttcgtgaatttgtattatgtcagatca

SEQ ID NO: 376319 - DNA, 906 bp, Homo sapiens
tctaggaagtccccaagagcacaggagcccagagacctcgcaggaggaagcagcagtatctgtgttccaaatcctgcccagcccccaggcagccatggtatcttctcagctggctcgagggcacacctcccaaaatgcagagaaggcagggtggctaggaatggctctagtagaattctccccttatcttgtctggaaacaaggggcaaagagctatctatttcctcctgccagcctcctgcccccaacaggattcctcacatcccaggaccagctggaaaaggtggtgagagttggaaagagactgctcagtgaggactgccctgcgaaccagcttggattcatcccgttcacctccacgttctgcactcggggccgagggaagggaggcagcccaggcagctagagaacttgatgaaacacactcaatctgaatctcgcttgatcgtcatgctgacccagtgaggccactcctcgacttttcagctcccgcacgattcctgaagcaggaaaagaaacagttctgtgaggtaagattcagaagggtaagataggccactcagctgccaccttgaggggggtactataagcaaactggagttcctagactacttatcaatcgtctgcttggccaggcacggtggctcatgcctgcaatctcagcactttgggaggtcaaggtggatcacttgaggtcaggagttcaagactagcctgggctacagagcaaggccccatctctacaaaaaaattttaaaaattagccaggtgtagtggcttgcacctgtagtgccagctatttgggaggctgaggcgggaggatcccttgaatccatgagttcaaggctgcagtgagctctgataatgccactatacttcagcctgggtgacagagactctgtctca

SEQ ID NO: 376320 - DNA, 368 bp, Homo sapiens
ctttgatactctaaattcaaccggtcatatttttttttcttttcctttctctttgactggtcaattcagaaaaggaagtccagttcgagtgttcagatgatggtgaggatctatctgccagatttctcctcctgtgaaaattcacacttaggaataaaagtcttatttacctaagatagtgtaagtaagtggagagggtgtaggaccattacaggtcagtgttagtcaactatcaaaacacggtacttctcttacatattacattgttttttctctgaaattgaatttgttatacatgtagatagtatattaagaggtttgctcttttacaaagtcaattttctctttgaaaataaaaagaccatgac

SEQ ID NO: 376321 - DNA, 590 bp, Homo sapiens
ctttctctttctgaaccacattgggtgccaacagaacttgctctctgttctctttcaaaattaccaacatggaccccacccaattcttcccttggaactaaggaacgcctgactgatcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtagatttccttgtttcataaaaaagactcacttattccatggatgtcattgatccaggcttgctttagtttcatgaatgaagggtactttagagaccacaacttctctgtccatgc

SEQ ID NO: 376322 - DNA, 508 bp, Homo sapiens
ctttctctttctgaaccacattgggtgccaacagaacttgctctctgttctctttcaaaattaccaacatggaccccacccaattcttcccttggaactaaggaacgcctgactgatcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtagatttccttgtttcataaaaaagactcactta

SEQ ID NO: 376323 - DNA, 1375 bp, Homo sapiens
ataagaggttgggctttggatagatagacagactcctgggtccggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagcccacaggtcttctgactcccgagccttctaaggaagggcccatcctcactgcagaatcagaaactgtcctccccagtgattcctggagtagtgctgagtctacttctgctgacactgtcctgctgacatccaaagagtccaaagtttgggatctcccatcaacatcccacgtgtcaatgtggaaaacgagtgattctgtgtcttctcctcagcctggagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtagatttccttgtttcataaaaaagactcacttattccatggatgtcattgatccaggcttgctttagtttcatgaatgaagggtactttagagaccacaacttctctgtccatgc

SEQ ID NO: 376324 - DNA, 1293 bp, Homo sapiens
ataagaggttgggctttggatagatagacagactcctgggtccggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagcccacaggtcttctgactcccgagccttctaaggaagggcccatcctcactgcagaatcagaaactgtcctccccagtgattcctggagtagtgctgagtctacttctgctgacactgtcctgctgacatccaaagagtccaaagtttgggatctcccatcaacatcccacgtgtcaatgtggaaaacgagtgattctgtgtcttctcctcagcctggagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtagatttccttgtttcataaaaaagactcactta

SEQ ID NO: 376325 - DNA, 241 bp, Homo sapiens
cttggggcatcagagcctagatataaggcgtatttgtgttctgttgacccttaagctaagcacccactcaataaatatttgaatgaacaagtagtaaatataagtattcatgaatgaatgcggaccactgcaaataatgagggctctggaatgtgcaacatgatactagaaatagacttcagcagatgctgtggctgtggtgataactgtatgtgaatctggggaaagaccccatctgacc

SEQ ID NO: 376326 - DNA, 3283 bp, Homo sapiens
  misc_feature (312)..(313): n is a, c, g, or t
gtagtcccggagtccgcgtgcgcggggccgggtccgggagccccagggcagccgccccgccgagtcgcagtgtcgggggctgcggggtgtctcggggccctggggtgagtgcggggcgcgggccgaggtttgcagggccctgtgagcgcgcccaggcacgtgttgcttcgggacgggccagccggtgggtgaaccctgccagccacgcgtggggcgggcccctggcacatctccagaccattgtctcctgtgccagaagctttgtaggtgcaacttccccttggagcagctgtgggtgcggatccagcggannaatcccgaggcgtctcagagagagcctggacagccgctggagcctttcccgagtgggtccttccaacaccgctacagcaggaaagccatccccctagggtcctgtccatcggaaactcctgtcctggggagtctgcctgcctggcctcaggacacaggccaactaagctggccccgaaatccagaatgcatccagagggaaggcacagtgtcaccttcgtcccctccggagctgcacgtggcctgagcaggatggtgccctccagcccagcggtggagaagcaggtgcccgtggaacctgggcctgaccccgagctccggtcctggcggcgcctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcccggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgag

SEQ ID NO: 376327 - DNA, 1850 bp, Homo sapiens
gtagtcccggagtccgcgtgcgcggggccgggtccgggagccccagggcagccgccccgccgagtcgcaggcacagtgtcaccttcgtcccctccggagctgcacgtggcctgagcaggatggtgccctccagcccagcggtggagaagcaggtgcccgtggaacctgggcctgaccccgagctccggtcctggcggcgcctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcccggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgag

SEQ ID NO: 376328 - DNA, 3702 bp, Homo sapiens
gtagtcccggagtccgcgtgcgcggggccgggtccgggagccccagggcagccgccccgccgagtcgcaggcacagtgtcaccttcgtcccctccggagctgcacgtggcctgagcaggatggtgccctccagcccagcggtggagaagcaggtgcccgtggaacctgggcctgaccccgagctccggtcctggcggcgcctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcccggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgcatgtggcttctctgtctctgtggaaaagccatctcaggttggcggcagacacattgtcatcagaggggagcagcggctctggtcctcggagctggttcctcttgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgagtgtgcgcagggcttctgattcagggccggcctggcctgggggttgagggtcagcagtcagtgaggaggccaggagaggcgtcccagccttctcccgcctccagcccacgcagggccttggtgcccatgagctgagcacccccacaaccctagtcaacggccctatcctgtggggcctctgccacatctcagcggccccaggtgaatggctggctgctcagcacggagagctggggagagaatctctggctggggaggggctgctggagctgctggacccaggggtctcccgaggtggctcaggggagcaggcatcttggggtaccctgggttgaggcagaggctgcacgtggaagatggcccgagtcagtggatggtgccagtcagacagggccatggtcccaggtgcatccaggggctctgtcatggccaccctggggaccctgcttgggggggggtctgcaccagccatttcctgggctcgtagatctagcaggatgtgatgggtggaggtgggctgggcctgtgccatgggctagagcgtcactggggaggcccacaccgccatcagaatcctcctcccagcgcctccccaacctgagggcctgctccctccgcagcctgctcactgcacccactgcctgcctgcctctgagtcctgcactcacccgtccaccaggacagggatggctgtcaggatgtagtgttgctgggagcaagtcaggtcctgctgtgaggagagacctaagagtgttggtgtgtgtccacacacccgtgcatgcctgtgtacctgtgcacactatggatgctcctgcacacctgtgtacaactgcacgcctgtgtatggccatgcatgcataccccatgtaaccgtgcgtgcctgtgcacactcgggatctgccagtggggcagtccagggataaaagactcctgagaactcctt

SEQ ID NO: 376329 - DNA, 2384 bp, Homo sapiens
gtagtcccggagtccgcgtgcgcggggccgggtccgggagccccagggcagccgccccgccgagtcgcaggcacagtgtcaccttcgtcccctccggagctgcacgtggcctgagcaggatggtgccctccagcccagcggtggagaagcaggtgcccgtggaacctgggcctgaccccgagctccggtcctggcggcgcctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcccggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtgaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttgaacgaatgactcgggttgatgttgccggatctcaggggtggctgtgactgacagaggaccttgttgcacctcgtggctgctttgttcacccgcagggcggcctgtgggcaccccggggttccccttcagtcccaaggaggggcgagcacacaccctggaggagcccagatggccttgtgctgagtgtggcctcagctcccattgcctcacgggg

SEQ ID NO: 376330 - DNA, 3542 bp, Homo sapiens
gtagtcccggagtccgcgtgcgcggggccgggtccgggagccccagggcagccgccccgccgagtcgcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcccggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgagtgtgcgcagggcttctgattcagggccggcctggcctgggggttgagggtcagcagtcagtgaggaggccaggagaggcgtcccagccttctcccgcctccagcccacgcagggccttggtgcccatgagctgagcacccccacaaccctagtcaacggccctatcctgtggggcctctgccacatctcagcggccccaggtgaatggctggctgctcagcacggagagctggggagagaatctctggctggggaggggctgctggagctgctggacccaggggtctcccgaggtggctcaggggagcaggcatcttggggtaccctgggttgaggcagaggctgcacgtggaagatggcccgagtcagtggatggtgccagtcagacagggccatggtcccaggtgcatccaggggctctgtcatggccaccctggggaccctgcttgggggggggtctgcaccagccatttcctgggctcgtagatctagcaggatgtgatgggtggaggtgggctgggcctgtgccatgggctagagcgtcactggggaggcccacaccgccatcagaatcctcctcccagcgcctccccaacctgagggcctgctccctccgcagcctgctcactgcacccactgcctgcctgcctctgagtcctgcactcacccgtccaccaggacagggatggctgtcaggatgtagtgttgctgggagcaagtcaggtcctgctgtgaggagagacctaagagtgttggtgtgtgtccacacacccgtgcatgcctgtgtacctgtgcacactatggatgctcctgcacacctgtgtacaactgcacgcctgtgtatggccatgcatgcataccccatgtaaccgtgcgtgcctgtgcacactcgggatctgccagtggggcagtccagggataaaagactcctgagaactcctt

SEQ ID NO: 376331 - DNA, 1226 bp, Homo sapiens
gtagtcccggagtccgcgtgcgcggggccgggtccgggagccccagggcagccgccccgccgagtcgcaggcacagtgtcaccttcgtcccctccggagctgcacgtggcctgagcaggatggtgccctccagcccagcggtggagaagcaggtgcccgtggaacctgggcctgaccccgagctccggtcctggcggcgcctcgtgtgctacctttgcttctacggcttcatggcgcagatacggccaggggagagcttcatcaccccctacctcctggggcccgacaagaacttcacgcgggagcaggcgaggacagggtcttgccctggctccggctgtcggtggcggggctggggctggagcggcggagccatctccttgacccctcatgaaatgccttctgctcctggccagtccgtccctctccctgccacccactgaccagatggcatctctgctcttagtggagggccactgtccaccgccaaggttatttataggggtgagcattatgtgtggcgtttcccttaaaataacaaaataagaaaagtctctagagcaaaaatgtttaaatcccatctgcctgccctctcatgttgtacattaacggattaaaaagtagattccagaaattaagccattccaccaggccttggatatcatcagagggacgatgggtgcaggtgctctgcgcacctgccacttggtggggcccccgatctcagcccctctggctgcaggagaggcccggggagagcttcatcacgccctccctcctggggcccgacaagaacttcacgcgggagcaggcacgtgggcgccggggtgcaggggcagccaccagtaggtgggcggggagcagcttcgggggcaagggaggcccagcctgccaggactcgccagcccctgttgttgccaggcttgtgtctaggaagttcacgtaagtggtgtcttgtgacccagctttcgcaagttgctctcctgcccaatctgacttgagagacgttccacgtgggttcgaggctgttcttaagctgcgcctcctgggttgaactacaaggtgcttatctgctgctttgctggaggtgattaggggattccggcttctcccactgcaggtgatggctgcaggtagagcacgagctggcagcctcaggcagtgggccttgacccagctggcccgggctggcacttccagttcactcctggggcgaatgctgcttc

SEQ ID NO: 376332 - DNA, 2838 bp, Homo sapiens
gtagtcccggagtccgcgtgcgcggggccgggtccgggagccccagggcagccgccccgccgagtcgcaggcacagtgtcaccttcgtcccctccggagctgcacgtggcctgagcaggatggtgccctccagcccagcggtggagaagcaggtgcccgtggaacctgggcctgaccccgagctccggtcctggcggcgcctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcccggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgag

SEQ ID NO: 376333 - DNA, 3780 bp, Homo sapiens
gtagtcccggagtccgcgtgcgcggggccgggtccgggagccccagggcagccgccccgccgagtcgcaggcacagtgtcaccttcgtcccctccggagctgcacgtggcctgagcaggatggtgccctccagcccagcggtggagaagcaggtgcccgtggaacctgggcctgaccccgagctccggtcctggcggcgcctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcccggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgagtgtgcgcagggcttctgattcagggccggcctggcctgggggttgagggtcagcagtcagtgaggaggccaggagaggcgtcccagccttctcccgcctccagcccacgcagggccttggtgcccatgagctgagcacccccacaaccctagtcaacggccctatcctgtggggcctctgccacatctcagcggccccaggtgaatggctggctgctcagcacggagagctggggagagaatctctggctggggaggggctgctggagctgctggacccaggggtctcccgaggtggctcaggggagcaggcatcttggggtaccctgggttgaggcagaggctgcacgtggaagatggcccgagtcagtggatggtgccagtcagacagggccatggtcccaggtgcatccaggggctctgtcatggccaccctggggaccctgcttgggggggggtctgcaccagccatttcctgggctcgtagatctagcaggatgtgatgggtggaggtgggctgggcctgtgccatgggctagagcgtcactggggaggcccacaccgccatcagaatcctcctcccagcgcctccccaacctgagggcctgctccctccgcagcctgctcactgcacccactgcctgcctgcctctgagtcctgcactcacccgtccaccaggacagggatggctgtcaggatgtagtgttgctgggagcaagtcaggtcctgctgtgaggagagacctaagagtgttggtgtgtgtccacacacccgtgcatgcctgtgtacctgtgcacactatggatgctcctgcacacctgtgtacaactgcacgcctgtgtatggccatgcatgcataccccatgtaaccgtgcgtgcctgtgcacactcgggatctgccagtggggcagtccagggataaaagactcctgagaactcctt

SEQ ID NO: 376334 - DNA, 3293 bp, Homo sapiens
gtagtcccggagtccgcgtgcgcggggccgggtccgggagccccagggcagccgccccgccgagtcgcaggcacagtgtcaccttcgtcccctccggagctgcacgtggcctgagcaggatggtgccctccagcccagcggtggagaagcaggtgcccgtggaacctgggcctgaccccgagctccggtcctggcggcgcctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcccggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtgaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgagtgtgcgcagggcttctgattcagggccggcctggcctgggggttgagggtcagcagtcagtgaggaggccaggagaggcgtcccagccttctcccgcctccagcccacgcagggccttggtgcccatgagctgagcacccccacaaccctagtcaacggccctatcctgtggggcctctgccacatctcagcggccccaggtgaatggctggctgctcagcacggagagctggggagagaatctctggctggggaggggctgctggagctgctggacccaggggtctcccgaggtggctcaggggagcaggcatcttggggtaccctgggttgaggcagaggctgcacgtggaagatggcccgagtcagtggatggtgccagtcagacagggccatggtcccaggtgcatccaggggctctgtcatggccaccctggggaccctgcttgggggggggtctgcaccagccatttcctgggctcgtagatctagcaggatgtgatgggtggaggtgggctgggcctgtgccatgggctagagcgtcactggggaggcccacaccgccatcagaatcctcctcccagcgcctccccaacctgagggcctgctccctccgcagcctgctcactgcacccactgcctgcctgcctctgagtcctgcactcacccgtccaccaggacagggatggctgtcaggatgtagtgttgctgggagcaagtcaggtcctgctgtgaggagagacctaagagtgttggtgtgtgtccacacacccgtgcatgcctgtgtacctgtgcacactatggatgctcctgcacacctgtgtacaactgcacgcctgtgtatggccatgcatgcataccccatgtaaccgtgcgtgcctgtgcacactcgggatctgccagtggggcagtccagggataaaagactcctgagaactcctt

SEQ ID NO: 376335 - DNA, 3641 bp, Homo sapiens
ggccgttgaggaggtgcagggagaggagcgggagggctctgggtggctgccaagggggagctctgcgctcagaccctcaactaagaccaggaggtgcctgatgaggccccagcctgcagagccagctcctggtggaagaggaaatgaggcatgctccattcattcggaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcccggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgagtgtgcgcagggcttctgattcagggccggcctggcctgggggttgagggtcagcagtcagtgaggaggccaggagaggcgtcccagccttctcccgcctccagcccacgcagggccttggtgcccatgagctgagcacccccacaaccctagtcaacggccctatcctgtggggcctctgccacatctcagcggccccaggtgaatggctggctgctcagcacggagagctggggagagaatctctggctggggaggggctgctggagctgctggacccaggggtctcccgaggtggctcaggggagcaggcatcttggggtaccctgggttgaggcagaggctgcacgtggaagatggcccgagtcagtggatggtgccagtcagacagggccatggtcccaggtgcatccaggggctctgtcatggccaccctggggaccctgcttgggggggggtctgcaccagccatttcctgggctcgtagatctagcaggatgtgatgggtggaggtgggctgggcctgtgccatgggctagagcgtcactggggaggcccacaccgccatcagaatcctcctcccagcgcctccccaacctgagggcctgctccctccgcagcctgctcactgcacccactgcctgcctgcctctgagtcctgcactcacccgtccaccaggacagggatggctgtcaggatgtagtgttgctgggagcaagtcaggtcctgctgtgaggagagacctaagagtgttggtgtgtgtccacacacccgtgcatgcctgtgtacctgtgcacactatggatgctcctgcacacctgtgtacaactgcacgcctgtgtatggccatgcatgcataccccatgtaaccgtgcgtgcctgtgcacactcgggatctgccagtggggcagtccagggataaaagactcctgagaactcctt

SEQ ID NO: 376336 - DNA, 492 bp, Homo sapiens
ctctactaaaaatacaaaaattagccaggcaaggtggcgcatgcctataatcccagctactctggaggctggggcagaagaattgcttgaacccgggaggcagagtttgcagtgagccgagatcgtgccactgcactccagcctgggtgacagagcaagattctgtctcaaaaaaagagtagtgctcaaaaaattaaacttggaatccagctttcagaatcttcacccagagttaggaggatcccttgaggccaggagttagagaccagcctgggtagcatagccagatgctgtctctacaaaagaaatttaaaaagattattggggtgtagtggcccatgcctgtagtcctagctacttgggaggctgaggtgaaaggatcacttgagcccaggattctaggttacagtgagctttgatcatgccactcacaccactgcactcctgcaacatttcactccagtcagggcaacacagcaagaccctgtctac

SEQ ID NO: 376337 - DNA, 186 bp, Homo sapiens
ggtcaaggaaggggcaaggaaatggaacagagtagagtggggccaagttttctgaattccaaggataataagacaattgtttgggttgtacaggaccaggctacagaggaatattgaaagttggcggaaggcacagacttgatgaactgagtggtagtggaataagtcgaatgtagatttactggt

SEQ ID NO: 376338 - DNA, 529 bp, Homo sapiens
gtggtgcaatcacggctcactgcagccttcacctctggggctccagcaatcctcccacctcagcttcctagctgggactacaagcatgcaccaccacacccaggtcaccatgcttggctaatttttctatatgttttgtagagatgggcttttgccttgttgcccaggctggtctcaaactcctgagctcaagcaatctgccgaccttggcctcctaaagtgctgggattacaggtgtgggccaccatgcccagcctatgctataatttttaacgctgcatattaatccactgcctggctgtgttttaatatattttcctagtctcctattcatggatatataggttgcttctgttttttccctattataaaaagtgtggtgattattttctttgagaatacatctttgtatacttgtctaaaatatttaaaattggaattgcttagtcagactgggcacagaggcttatacctgtaattccagcacttggggaggctggtgagggagaattgcttgaggccaggagtt

SEQ ID NO: 376339 - DNA, 299 bp, Homo sapiens
caccctcccttcacttgtgccatccccacgctttgtccttaagctgtagtggtcccaggagataacctgtttacagcagcccattcagtattgaaaaatgaactccctcctgcagaatgttagaagaaacaacctcaaagacctcaggccacctgtggtcattagtatgtggcagcaagattgaacctgcctgcctcctacctgtgtgagcctgtggtgtgggtgtggtaccaaggccctggctctgggcagtctgttggctcctggtgttcactaaggcgtggggtgacaggccatct

SEQ ID NO: 376340 - DNA, 413 bp, Homo sapiens
aatgcctagatttcaatcctggccctgtctcttaataattatgtgatcttgtgcaagtcctgagcctcagtttccttaacttgaaaattgggataatagtatctatcttggagttggtatgaaaattaaacacaatttggctgggcacggtggcccacgcctgtaatcacagcactttgggaggccaaggcgggtggatcatctgaggtcaagagttcgagaccagcctggccaacatggtgaaaccctgcctctattaaagatacaaaaaattagctgggtgtaatcctgtaatcccagctactcaggaggctgaggcaggagaatcacttgaacccaggaggtggaggttgcagtgagccaagatagcgccattgcactccagcctgagcaacagggtgagactccatcta

SEQ ID NO: 376341 - DNA, 309 bp, Homo sapiens
gtgattagtgacatcttaagctaactgaaatcagctggtgcattgtcctacaccggtgcattgtgctacactatgctgttactgctctgtttgcaaatttatcaaattgtgtaattttgaaagctgacaaaattgttacttttgaactgattatttttgtattagagattatttaatttggtgaatggttacgcaagtgagatccttgaagattatagagcttcatcttttgatgacttggagtcagggaagagttaactatatggaaataggcagaatgcctaggttcttgtatcttttgtttttaaa

SEQ ID NO: 376342 - DNA, 1351 bp, Homo sapiens
tccagaagccctgaggagccgccccatgcctgacgccacatcccacaagctcccgaagtcgcggatggctcagtgacattccagatgctgtcccatcgctcagagtcccgagacacagacatgaacaccaagtccatcctttgaggaaggcagacttggcgggaatgtggttttcttcaaaggtgagggggtagggggagctgccagggcccagccggcaggggcaggaggggcggggcttcggcccagggccctgcacgggggtgaccatcagtgccccccatcaccgtgacagtcctatccccagtctgcaaaatgccccctggatggagcatcccatgagagccgggccatggagaggctggaatgtgccagactctgaggcacccagggggtcagcctttccctctggttggtccccctgtgccacaccgcagcctgcgcctggccagcttcccgtccctgcgagcacagcctgcgcctggccagcttcccgtccctgctgcgaccccattactaggtcatcgtctcatgccagagaactcgcaggaatcgcatgcaatgtttaacgagaggcagaatgtgggcaccaggtgtgaagcagtccccggctgtggacgggagactccaggctgcgccaggcagggcgccttcccctggaccttgaagggcacccgatgtcctggggccgtgaggggcggggtgcttatccatgtgacaggactcttccagtagcaacagggagggcccagcaaaacccgcagtttgtttcgggccacgttccaacaagtgactcggcggcgtctcccacctgcacactcagtcaggaggctgcagtctcccgtccagccccacagcctgagggattcctgttggttacccagaactgcctgccacaggtgccagggcaagagatgtcactcaattttccagcccccagtcctgtagacatcctgggtgtgcggcacacatcggctcactcacactgaccctctgagccggtgagaactccacaagaagagggccagcgcctcacaagatcaaggcggaacaacgcgtttgtgggatgatgaagacctcataacagacgtgccagtgggttgattactgtgaaattctcaactgtggtttctgtaacttaaaaaaaaaaatttccactttgggaggccgaggcgggcagatcacgaggtcagaagatcgagaccatcctggctaacacagtgaaaccccgtctctactaaaaatacaaaaaattagccgggcgtggtggctggtgcctgtagtcccagctatctgggaggctgaggcaggagaatggcgtgaacccaggaggaggagcttgcagtgagcc

SEQ ID NO: 376343 - DNA, 336 bp, Homo sapiens
tctcctaatgctacaaaacatcttttgccttcatgtttgaataaaaatgttgtatggcctggcgtggtggctcaggcctgtaatcccaccactttgggaggccaaggtgggtggatcatttgaggtcaggagttctagaaaagcccggccaatatggtgaaaccttgcctctaccaaaaatacaaaaattagccgggcatggtggtgggcgcctgtagtgtcagctactcaggaggctgaggcaggagaatcgcttgaactcgggaggtggaggtagcagtgagccaagatcgcgccactgcactccagcctgggcgacagagcggaactgtgtct

SEQ ID NO: 376344 - DNA, 435 bp, Homo sapiens
gagctcaatgtagagttttttgtgtggattgtttttaatgcatctttttttttccacacagatctgcaaaatcactcttagattctgttaagtccctgtcatacccctttctattaaacacgattctcacagaccacaacagactcattccttccttctgcctcatgctaactaaggtcattcggtaaacacaggagtatttaagttcagtaatataacttcctccgagtctctgttggcatagttttttcttcctttctctttcactagtcagagcttttacgagcatctttagaaacagttctgccctgtgctaaaccttttgcctgaataaaggtactaacagtggttgtattttctaatgatgttgactgcttaatcagagcaactttgggaatggattttggcagacttagtactcaaaccctttacagc

SEQ ID NO: 376345 - DNA, 380 bp, Homo sapiens
gtgtgtctatcagtagcattttacatacacagacacccatatgtaaatatgaatgttatattacatgaagtattttaaacttgcgtttgctattgtgactatatttccgtttcaatttctaactggtgattaataatatataaaaaaactgtcaatttttggccgggcgcggtggctcatgcctgtaatcccagcactttgggaggccaaggtgggcggatcacgagatcaggagatcaagaccatcctggctaacacggtgaaaccctgtctctactaaaaataaaaaaaaaattagccaggcgtggtggtgggtgcctggagtcccagctactcaggaggctgagacaggagaatggcgtgaacccgggaggcggagc

SEQ ID NO: 376346 - DNA, 515 bp, Homo sapiens
gtcacatacttctagcaatttatccatttttttctaggttttccaatttgttgacacaattgttcctagtaatttcttatgattctttgtatttctgctaagggttagtctgcgaagggttggtcaactttgttcagctcttcaaaacaccatcttttagtttgttgatctttttcagttttttcattgtccttattttagttacttctactctgaatcttattttctttctgctaacttttgatttacatttgacccttacacagcatacagttgaattgcatggatccactaatttacagaatatttcaaccaaatgcagatgaaaaatacagtacttgtggaatgtaaaacctgcatatacagaggacaacattttgtaaccaagggttctgcaggtctgactgtgggatttgagtatgcagattttggtatacatagggggtcctggaacctatcctctctgtatatcgagggatcgttgtatttggcttttttttccttttccctagttt

SEQ ID NO: 376347 - DNA, 632 bp, Homo sapiens
ttaagtccaactcagcccaaaatacagcatcctgacgacaaaactcaggttaaagaggaaatgatggacaacagaggcaactctagtctacctgacaaacttcctatcttccctgattctgcccgcttgccactgaccaggtccttctatctggagcccatggtcactttccacgtgcacccagaggccccggtgtcatccccttactctgaggagctgccacggctgccttttcccagcgactctcttatcctgggaaattacagtgaaccctgccccttctctttcccgatgccttatccaaattacagagggtgcgagtactcctacgggccagccttcacccggaaaaggaatgagcgggaaaggcagcgggtgaaatgtgtcaatgaaggctatgcccagctccgccatcatctgccagaggagtatttggagaagcgactcagcaaagtggaaaccctcagagctgcgatcaagtacattaactacctgcagtctcttctgtaccctgataaagctgagaccaagaataaccctggaaaagtttcctccatgatagcaaccaccagccaccatgctgaccctatgttcagaattgtttgagttgctgtttccaaatagaaatgaat

SEQ ID NO: 376348 - DNA, 635 bp, Homo sapiens
gtgagcgcgatcattagctatctgcccgtctatcttatactgattatttcggttaaagaggaaatgatggacaacagaggcaactctagtctacctgacaaacttcctatcttccctgattctgcccgcttgccactgaccaggtccttctatctggagcccatggtcactttccacgtgcacccagaggccccggtgtcatccccttactctgaggagctgccacggctgccttttcccagcgactctcttatcctgggaaattacagtgaaccctgccccttctctttcccgatgccttatccaaattacagagggtgcgagtactcctacgggccagccttcacccggaaaaggaatgagcgggaaaggcagcgggtgaaatgtgtcaatgaaggctatgcccagctccgccatcatctgccagaggagtatttggagaagcgactcagcaaagtggaaaccctcagagctgcgatcaagtacattaactacctgcagtctcttctgtaccctgataaagctgagaccaagaataaccctggaaaagtttcctccatgatagcaaccaccagccaccatgctgaccctatgttcagaattgtttgagttgctgtttccaaatagaaatgaat

SEQ ID NO: 376349 - DNA, 341 bp, Homo sapiens
ccaggctgaagtgcagtggagcaatcacagctcatggcagcctcgacctccccaggctcaggtgatccttccatttcagcctcccagatagctgggactacaggcatgcaccaccactccgggataattttttcatgtgtgtatttttagtagagacagggttttgccctgtttctcaggctggtctctaactcctgggctcaagtgatctgcctgccttggccttccaaaatgctaggattacaggtgtgagccactgtgcctgacctgttcctgatttttaaatacctggttgtcctcttcttttgtcatttctttattattatgtaatcctattcacc

SEQ ID NO: 376350 - DNA, 439 bp, Homo sapiens
ttcatttctcatactaatgctagtgaatcactagcattagtatgagaaatgaaatgcctctggaattgtttttttcttaaatttggggacagtgtcacttaggataaggttcaactaatagcaacataaaatctaaactaaaaatgacttaattaacacagaaagccaggcacagtggctcacacctgtaatcccagcactttaggaggccgaggtgggcagatcacctgaggtcaggagttcgagaccagctttaccaacatagtgaaacctcatctctactaaatatacaaaaaaaaaaaattagtcaggtgtggtggtgggcgcctgtaatcccagctactggggagaatcgcttgaacccgggaagcggaggttgcagtgagccgagatcacaccactggactccagcctgggcaacagagtgagactccgtctc

SEQ ID NO: 376351 - DNA, 1234 bp, Homo sapiens
caggtggagaagtccaggttttccactggcctctgttgacacctcggggtgtctagtgatttcttgttactgcttagtgggaatgagagttccagctcccccatagcctccagtgagaccgctgtggagatggccttgttacacttgggtgatggtgaaagtcctgaccctcctccaggcctctgaggccaccccagtaggcaggcggagggacatatattttgccaggttgcggtggaagtccaggctccccaaatggcctctactgacaccacaggggtaggaaaatttttttacttggccattggggatgaacttcctggttccatacttagccttctctggcaccatcttggtgggagtattagggtgccttgttactgccttgtgagggtagaaattgtagctgcccacccagcctttgctggttcaggtgggtcagggccacagtttttcctctcatttttgcccggagtacagtggttattatctaagattgttccgtcttgctaggctgctttagtcctttggctagagaaagtgggtgttttttgttgttttgttttgtttgagtctgtgctcaatgacaatttgccagcttcctcagctccaaattcagagtatatgaggcataagaaagcccaaggaactcactgctgtgcatccttgggtcccaaggtctttagtttttctgtcttctctccacctttaaaagtcttcttatgtttggtttacataagatgcccgaagttttcagttgtacttagtgggaggaatagagaaaagtatatattctattccttcctcgaaatcctctgaaaacattttgatcatgcttacacttttctaattataacagtatggtttcattttagaaaatttgaatatgttttaaaaaataagaaaatttaaattacctagaatcattatttaaagttaactatttccagcttttttctacgtaaagtgtattattgtgtgtgtgtgtatatatatatatatttttaatttctttacaaaattggaatcttactacaaattgaggtttctattcaatttttcccataacattaataaaattataagctttttctgatatttgaaatatccatctgttcagtggagataccagttcactcgtttgtgggtacaccattatccagcttctgtggtaagcagagcacttaagaggaaaggcaggcatatgggcctccgtgagctcacagtggtgggg

SEQ ID NO: 376352 - DNA, 576 bp, Homo sapiens
gaggagcatggctggcaattcgaaaggaggtaatctctctggggtacaatggagtagaaaacttagggacagaaggaatatacgaatggagaaattcgatttgcccaatctttattgctcacctattaaagtgctaaacaagctgatggtgattcctgttctcagaagcctgtgttctagcaggttataagaagatgagtctggttaaagagaagagcagggaagtggcttagattatggcataaactgaagttgaaactcagaatgaaaagtaggagtttgctgaggggaaagcaatatataaagtgatttgtgctataggacataagacagattatagataagagaactcagaaatagtaaggacagtggtaaaaagttaaaggatcctccctttccccagttaaccaggagaccaaataagggacttggtggtaggagtggtaggagcaggatcaatcacttatttattaagcacctgcacatgattcaaagaaggataagacggcccctacccttaaggagtttatgttctttctagttgtgaatagagaaagcatatgcaaaaaaaaaaaa

SEQ ID NO: 376353 - DNA, 2825 bp, Homo sapiens
gcagggcgaaggcgcgggagcagtttccagcagagggcggcaccactccctgctccatggaaactgagcaagttgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaacttttttgaggaacactgctatgtcatcctccacgtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggctttgacctacagcctccgggacagggaacgtggtggtggtcgtgcacagattggtgtggtggatgatgaggccaaagccccggacctcatgcagatcatggaggctgtgctgggccgcagggtgggcagcctgcgtgccgccacgcccagcaaggatatcaaccagctgcagaaggccaatgttcgcctgtaccatgtctatgagaagggcaaagacctggtggtcctggagacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccataaaaaaaaag

SEQ ID NO: 376354 - DNA, 1102 bp, Homo sapiens
agctttctccatgagcagagagggaccctgtacccagagcagagcggagtgctcggggagaaaccacggggctcagaggagggcccagggctcccactcctgagaagtggcttcccaggccctggggtggggcacttgtgccatgggctggggtgcccctctgggtggctcacagccttgctgtccgtgctggccaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccataaaaaaaaag

SEQ ID NO: 376355 - DNA, 411 bp, Homo sapiens
gagcctgtgctgtttgcagagcctgtgtttatacagagttcagctctgtttcaagaatttgtcagttgctgcagaatctgagtcttcatagtctgtgtgctgacatttgtgtgtttacagagccctcctaataaaagtcatgttctataatgaagttgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaacttttttgaggaacactgctatgtcatcctccacgtgagtcgcttggggaagtctgcctgagaggggtg

SEQ ID NO: 376356 - DNA, 2643 bp, Homo sapiens
atcctccccttctccacccgcacctccgtcttccccgcaacacatatacacaaacacccggaccctaggtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggctttgacctacagcctccgggacagggaacgtggtggtggtcgtgcacagattggtgtggtggatgatgaggccaaagccccggacctcatgcagatcatggaggctgtgctgggccgcagggtgggcagcctgcgtgccgccacgcccagcaaggatatcaaccagctgcagaaggccaatgttcgcctgtaccatgtctatgagaagggcaaagacctggtggtcctggagttggcgacccccccactgacccaggacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccataaaaaaaaag

SEQ ID NO: 376357 - DNA, 2951 bp, Homo sapiens
gagcctgtgctgtttgcagagcctgtgtttatacagagttcagctctgtttcaagaatttgtcagttgctgcagaatctgagtcttcatagtctgtgtgctgacatttgtgtgtttacagagccctcctaataaaagtcatgttctataatgaagttgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaacttttttgaggaacactgctatgtcatcctccacgtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggctttgacctacagcctccgggacagggaacgtggtggtggtcgtgcacagattggtgtggtggatgatgaggccaaagccccggacctcatgcagatcatggaggctgtgctgggccgcagggtgggcagcctgcgtgccgccacgcccagcaaggatatcaaccagctgcagaaggccaatgttcgcctgtaccatgtctatgagaagggcaaagacctggtggtcctggagttggcgacccccccactgacccaggacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccataaaaaaaaag

SEQ ID NO: 376358 - DNA, 1736 bp, Homo sapiens
cgcggcgggacctggaatcttggagggatggttgaggagtgggcggggcggagatggtgttgggggggggcagagggcgccactgacgcctactgtccccccttcagataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccataaaaaaaaag

SEQ ID NO: 376359 - DNA, 1348 bp, Homo sapiens
atcctccccttctccacccgcacctccgtcttccccgcaacacatatacacaaacacccggaccctaggtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggctttgacctacagcctccgggacagggaacgtggtggtggtcgtgcacagattggtgtggtggatgatgaggccaaagccccggacctcatgcagatcatggaggctgtgctgggccgcagggtgggcagcctgcgtgccgccacgcccagcaaggatatcaaccagctgcagaaggccaatgttcgcctgtaccatgtctatgagaagggcaaagacctggtggtcctggagttggcgacccccccactgacccaggacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggtcctgcaaggcttatcgcccgaggaacatagatatcgtgtgtgctcggagtaaaggccccaggt

SEQ ID NO: 376360 - DNA, 120 bp, Homo sapiens
aaatcgctatttgcagagcctgtgctgtttgcagagcctgtgtttatacagagttcagctctgtttcaagaatttgtcagctgaagcggaggatcacttgaacccagaaggtggaggttg

SEQ ID NO: 376361 - DNA, 2868 bp, Homo sapiens
gcagggcgaaggcgcgggagcagtttccagcagagggcggcaccactccctgctccatggaaactgagcaagttgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaacttttttgaggaacactgctatgtcatcctccacgtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggctttgacctacagcctccgggacagggaacgtggtggtggtcgtgcacagattggtgtggtggatgatgaggccaaagccccggacctcatgcagatcatggaggctgtgctgggccgcagggtgggcagcctgcgtgccgccacgcccagcaaggatatcaaccagctgcagaaggccaatgttcgcctgtaccatgtctatgagaagggcaaagacctggtggtcctggagttggcgacccccccactgacccaggacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccataaaaaaaaag

SEQ ID NO: 376362 - DNA, 2721 bp, Homo sapiens
atcctccccttctccacccgcacctccgtcttccccgcaacacatatacacaaacacccggaccctaggtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggctttgacctacagcctccgggacagggaacgtggtggtggtcgtgcacagattggtgtggtggatgatgaggccaaagccccggacctcatgcagatcatggaggctgtgctgggccgcagggtgggcagcctgcgtgccgccacgcccagcaaggatatcaaccagctgcagaaggccaatgttcgcctgtaccatgtctatgagaagggcaaagacctggtggtcctggagttggcgacccccccactgacccaggacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggagggcctacctgggatttgaccagagtccgcctggctccaggtctgcaccccacaggaagaagaaactacactgacagatgtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccataaaaaaaaag

SEQ ID NO: 376363 - DNA, 3201 bp, Homo sapiens
atcctccccttctccacccgcacctccgtcttccccgcaacacatatacacaaacacccggaccctaggtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggctttgacctacagcctccgggacagggaacgtggtggtggtcgtgcacagattggtgtggtggatgatgaggccaaagccccggacctcatgcagatcatggaggctgtgctgggccgcagggtgggcagcctgcgtgccgccacgcccagcaaggatatcaaccagctgcagaaggccaatgttcgcctgtaccatgtctatgagaagggcaaagacctggtggtcctggagttggcgacccccccactgacccaggacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggagggcctacctgggatttgaccagagtccgcctggctccaggtctgcaccccacaggaagaagaaactacactgacagatgtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggaggtaaggtggctatccctgcctggtggggctgtgaacgggggtgtgtttctgtttgtgtaactgggtgtgtgtgtatctagccatctgcctctgtacacagggctgtgggtgagtctgaccctgtcactgagcaattgcattgcggtgcatatgagaccatggatgagtgtgcatcaccaggtggcagcagtgagactccgggagattaggagtgtgttggaactcaggggtaactgagaccatgtttgcagttgtgtgtggccctgtgtgccttatgatactatgtgtggctccagcgacagtgcctgcggccgagcatgtgtcggtgctgcatgagtgactgtgattggaatgcccaatcgcatcattcatgtgtgtggcttggtgtgagtgtttgccttcgtgcacctgtgtgtgacactttgtcagtgactgtgaggtcacgtgatgctagaactggccagaccagtggcaactggtgaaaatgtgtctgtgagcaagactatgactggctgtgggcgaatgatggatgggtgtgtttgtgggtctgtgtttctgcgcacagtggtataactggccgggtgtgcgtggctgtgtaaacaagtgctgttgtgtttgcatgcagctctgtgtctgacaacagtggatgacagtgtgtggctatggtttgctgtctggctgtgtggcgatggatgactgtgtgtctgtgtaagctgcaataatgtgtgttctctgcatctctgtggggccgtgtctacagcactgtttgaattggtgatgaagctgtgtgctcccatctactcagaacaaacccagagctcttaccacagccctacgtgacctggccagccccaactctttgacccaatttccccctgctcccccctcactgcttctgctgcagccacaatggcctctttgtgttccctgaacatgccggcacacggccacctcggggcttttacaccggttgtttcttctggttaggacacttttcctccagacatacatgtgacttgctctctcatgaaagctctataagggcagggatttttgtccattttctttcattgttgactccccaaagcctagaccaatgcccggcacacagtaggtgctcaataagtatttgtggattgatctccaggtaaatcatgcaagaaaaaaaaaatgtgtggattgaacgtgtgtgtgcatgtatgcatgcattcctgtgaccttctcgtgtgttcacgggtgt

SEQ ID NO: 376364 - DNA, 537 bp, Homo sapiens
ggttatttttaatttttgtcccttaaatttttaccttcttcagaattacattttatggctaatatattggaaagtgatgatatcttccattgaatcttatctgaagactgtattatttttaatggagaaaatatactgtaaatatacttgtaagcttgcttatttatttatttatttttagagacaggatctcaccttgttgcccaggctggagtgcagtgacacgaccgtagctcactgcagcctcaaacttctgggctcaagcgatccttctacctcaccctcccaagtagctaggactacaggtgtgtgctgccatgcccagctatttttttaaagtttgtatagagatgaggtctcactgtgttgcccaggctagtttcaaactcctgggctcaagtgatcctcctacctcagcctcccaaagtgttgggattacaggcatgagccactgtgcctggccaaacttgctatcttaaagttggaggtacaaaatggacgcttaacaaacagtaatgacaatgataataatttgct

SEQ ID NO: 376365 - DNA, 320 bp, Homo sapiens
ctactactactaaattagcggaacgtcgacgaaaggaacaatccatggactggtaggcgcacatcatcgaacggaatcgaatggtatcattgaatggaatcgaatggaatcatcatcagatggaaatgaatggaatcgtcatagaatggaatcgaatggattcattgaatggaatcgaatggaatcatcgaatggaatggaatggaacagtcaatgaactcgaatggaatcatcattgaatggaatcgaatggaatcatcgagtggaatcgaatggaattatgatcaaatggaatcgaatgtaatcatcatcaaatggaa

SEQ ID NO: 376366 - DNA, 274 bp, Homo sapiens
aagtttttaaatttttaagccaaacttccttctcccagcctcacccatctctccagaaccttaaatagttgatcacctcctcccctacctgtagatggagccacacccactcaaacagagcctttctcagccatgtttaaacatggtcggatgctcacggctttcagaactcacccaaccccatatcccttgctaacttttgccttctcccctatcttcggggtcagatgcttgagaaacttttctatattgacttcccacctcctcacctcaa

SEQ ID NO: 376367 - DNA, 504 bp, Homo sapiens
tcaatttaatgataatttcaggcccccaccctgctaaattgtctactaattgctgaaatgccccactgtctcagcccaagtgtttccttgaagtctgaagtcagctatttccacactatgttttatccttggtcatccttggcatgccatggcgccacccttgggcccagccactgaggtctgttccagtccctgggacttcatcttgagaaaagtcttctttgatcatacttccccagaaggactcctctctcacctcaaattctgatcccaacaatgagtttaggcttttgaaagtaaaagacagggccgggtgcggcagctaacgcctgtaatcccagcactttgggaggccaaggtgagtggatcatttgaggtcaggagttcgagaccagcctggccaacatggtgaaaccccgtctctactaaaaatacaaaaattagctgggcgtggtggcggacacctgtaatcccaactacttgggaagctgcagcaggagaatt

SEQ ID NO: 376368 - DNA, 925 bp, Homo sapiens
acttgctatgctgcccaggctggagtgcagtggctgttcacaggtgtgatcatagtgcactgaggcctcaaactcctggcttcaagcagtcctgcctcagcctcccgaaaaggtggaactacaggcacatgccactgtgccttagccaataggtattagaggtagtcaagtaggtatagcataaccaattacaaactttaaaatcaaatgatactgaatgctttttcataaaatccttcttaacatcactttcataactgaagcgtttggaaaaattctggagttcatatttgttcacaagaatgggtgggtgtatttagaatctgccagtctatcagctttactgaggggagatactaaaaatatttaacaagtagtataatatagagaccgagtcaaaatggatactagctggaaacaactggttcaactgttgcctcctgactaaatgtcagcccagggtatagtaaccatgacacagtactatccttggtgaagagttgggaataggattaattgcggaaaaaatatatataaatgccataggacacttttagcacaaaagtagttgtttacctcccattctcctcctttaatctcagtgcttttactatttggtttcttttttggcattttacaaaagggaagaaatggaaaacataccccttcttggtcattgggtaacagcaccatttcggtaacagtcatacttgatgacaagtatgatgatattttaaggacatgaacatgggtgaaatcaatgtgtagatggtacaaattaaccgaattctttttaaagcatttcctgtggatcccaggatcatgaggacataacagaagaataaggtctgaatcttgttcaccagtttgctctcagcctaattgggaagtaaggttaagcacctgaaaattatgtcatacaaaa

SEQ ID NO: 376369 - DNA, 346 bp, Homo sapiens
tgcagattcaaggcagactgtgaggtatttgatagtcctactcgtgtgttctcatgtgcatcccatctttccaaaagtgcacacttgaaacagatgattttgagaagagctgcttctaccaacttgatcttggccacttgttgtattgttgtgcgttcttagtttttctacttttaccatttctggccagagctgtcacttttaaaaattactccgttgatgttgcctagcaagagccactcagctctttgtggggaattaaagtagattataggttgaggccagttgcacttactgtgctgcaaattggggactgatgatctagtcatcctcttcctttcttaca

SEQ ID NO: 376370 - DNA, 447 bp, Homo sapiens
ggccgcctttcatctcaacctctgaggacagaagggggctctcaaatccgcccatgcattgagatcttcgctcttcacagaggtgggattagtagcttagtctcagtttcaagtggatgaggttgtgtaatttcaagggaaaattacatccggcaatacctcttttgctaatggaactcaggaaggaaaggccctcagaaaggctggagtctggaatctaggcaggtagctggcctgacagtaaccttgatccaggtaaaccaaagtggaattctcgagcctggaattgatgactcataattgttttcatttaacagctcaggatgtgtgaaaaaaaaatgctgtttaatttgtaagacctaagtttacgactgattttggagaatacatttgtgataatgtatctatgttttcctggggtggcggaggaaatgatttctacctaaa

SEQ ID NO: 376371 - DNA, 560 bp, Homo sapiens
tgaacagatcaacaagtatttggtacttgttagaaacctttcagagctcactaaagcaacatttcttttgcagtctggtgcctttggccttgcagtcagtcacttaaccctttcaagtgtgaagagcgttcatcatttggaacctccattgcccatagcgatggctggatttctaaagggtttactcaggggaataacttattcggaaaatatattcccattgtcacattttaaaacttgacagccatcataacaaaaactggtactgacagtaggcagacattctgaatgtattcattcttaatttggatctattggctgtgatttgaatgatctttggtagtaagttaaaaggatttttttttccttagctaagcgagaaacgatagaggcctatagctagaggactgatagtgcatggtgcttttggacaataaacatgtactttattttaggatgtaatttagtgagcagttagaaagcagtattctagtctttgcattagggcaccactgatgaagctggctaagcaaagagaaataatattatggcaaaaagga

SEQ ID NO: 376372 - DNA, 3393 bp, Homo sapiens
gaaggctacagagagagccaggttttggtgccatgcacacagggaaacttagagttcagagagggggtgtgatttgcctgaggtcacacagcaagttagagacccagctccacgactcattgtcttgctgcccagagctgctggctcccctgtttactctgagctgatcgatcaccttagcacacagctggctaggagagaaccatgcagtcacttcggccacacctgcccgttgacccttgctacctcggcaggctttgatcccttctgacctggaggccagaggctaggctgaggtcactcagcagacatcaaggacctgggcagatgggccggctgggatggtggcgagctgtacagataaaaagggacatgaaaatgaaaagcccgagcctgagttttcatcacggttccactcctgagtggtcttgggtgaatcacttcatctgccaaggcctggatttcctcatctgcaaactcagaaaactaaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacctctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagccttcgcatgccgttcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgccttccatgcgtgctggtc

SEQ ID NO: 376373 - DNA, 3156 bp, Homo sapiens
acatgggattctgcgctgggaggaacagggtaaggcgtgaacgtggagggcagtttccctttcaggtcccggctctcttggctttcccataagcagctgccttgggactctcctggagacctgatgcccacagccaagctgaccacaggagccggtgctggggactgagggaaacttagagttcagagagggggtgtgatttgcctgaggtcacacagcaagttagagacccagctccacgactcattgtcttggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacctctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagccttcgcatgccgttcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgccttccatgcgtgctggtc

SEQ ID NO: 376374 - DNA, 798 bp, Homo sapiens
gaggggttaagtgagcagccttaggtggcgcaggtcggcagcagagccaggactggaacccaggcagcgcacactcattcgtagtcacggtattgctgcctcccttctcacctcaaacggttcattcattgactcactcatactgtgcggtgctggccatgtgctccgctctgggctgggccctggggttgcacacatgaggaaccttctgcgcctccctcaccatcagctccaaatccctgcctcttctctccacagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgc

SEQ ID NO: 376375 - DNA, 3125 bp, Homo sapiens
ggcagtgggtgaaagcaggggtggtcatctgacgaggggaggggaagcaggtggtgcccagcaaggtggaaggagaagtggacaggagaaacctcggggcattcccgagggcccaggaactgcaataaatgatcacagggaaacttagagttcagagagggggtgtgatttgcctgaggtcacacagcaagttagagacccagctccacgactcattgtcttggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacctctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagccttcgcatgccgttcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgccttccatgcgtgctggtc

SEQ ID NO: 376376 - DNA, 2653 bp, Homo sapiens
acccccgcggcggacgcccgggccgccccaacgccgctgcgcggtggagaccgcggtggaacccgtccttgccagggtgggctcgccgggccccaaaggagaggttttgttcatagtcagcattgatttttcagccaggctgttctgaaaggtccacagtccttcgttaagtagtgagcacttcgggaggctgaggcaggaggatcgcctgagcccgggagttcgagaccagcctgggcagcatagcattggtctggcatctgtggtcatcgagtcatatttgaatgtctactacatcatcatccttgcctgggctctcttctacctgttcagctccttcacctctgagctgccctggacgacctgcaacaacttttggaacacaggagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagccttcgcatgccgttcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgccttccatgcgtgctggtc

SEQ ID NO: 376377 - DNA, 481 bp, Homo sapiens
aaacctgttttcagatgatgattttgagtgagatacaagtgtagctacttggaaaagattcagtagcatccctgagctatagtgatagaaaccccgtccttgtcccttctgtggagcagcctgttggagcttctctgggttggcctaggcccagagatgaggtcagcagctcaagggtctagtgtttttagctgtcttcccagccctgctccagagcccccatgtaacctgctgccctgcagtgcccagcacagagcagtgtctgttgaatgcgtgagtcaagcaaaacatcaaacagaatccttgacatgggaaaaacatgctcccagccaccaccagctgaacattgacatccagctgctttcccactgggcagtggcttgtgaagatggggacagagtatcataaatcatctcctttgtggacagcagggatgatcctgaccttcttgtcacagactaaacagactaagtagccagaa

SEQ ID NO: 376378 - DNA, 281 bp, Homo sapiens
gccatcccagcctctgtgcaaccctggggaacacggcctgtgagccaaagcagacttggcgtcctgctaagtaggaacatctctgtgggctccctcctccctctctctctctgtctcttttgaacagtttgagtaggattggtatttgttcttttaatgtttggtaaaattcaacagtaaagctatcaggtccctggcttttctttgaggggagattttttataatggcttcgatatcattatttgttattgattggtttgggttttgtatttcttcatgt

SEQ ID NO: 376379 - DNA, 459 bp, Homo sapiens
tgagtggccgttccgacctccggtcaggagggggaggaacagagcacggccggcggctgcacgggcagggcctctctgggctgagaggaagaaaccagtgagacatcgagaggaagtcgctgtggcactcagtcctacggcctccgaggctgggtagtgagtgtgtcgctggccttagccagactccacaggccacgctggctgcgaatggagccgaggactcgcgcggaggcgagatgctaccagccggcgagatcggcgcctctcctgcagccccgagctgctctgtagggaccaaaggacaaggcagagaaagtgcagataagggtgagctgactccatatgggcctgcgttcatcgataacgaactgtgtgaccctagatcgatgcgagactttagaaccccatagagcagacgacaggattatgatgcagtaccagccatgtactcacgagtcg

SEQ ID NO: 376380 - DNA, 2982 bp, Homo sapiens
tgagtggccgttccgacctccggtcaggagggggaggaacagagcacggccggcggctgcacgggcagggcctctctgggctgagaggaagaaaccagtgagacatcgagaggaagtcgctgtggcactcagtcctacggcctccgaggctgggtagtgagtgtgtcgctggccttagccagactccacaggccacgctggctgcgaatggagccgaggactcgcgcggaggcgagatgctaccagccggcgagatcggcgcctctcctgcagccccgtgctgctctgaaagtggtgacgaaaggaagaacctcgaggagaaaagtgacataaatgttacagttcttattggaagtaaacaagtcagtgaaggtacagataatggtgatctcccttcttatgtgtctgcattcatagaaaaggaagttggaaatgaccttaaatctttaaagaaacttgataaactcatagaacagaggacagtaagtaaaatgcagttagaagaacaggtacttacaatttcatcagaaattcctaaaagaattcgaagtgccttaaaaaatgcagaagaatcaaagcaatttcttaatcagtttctggagcaggaaactcatctcttcagcgccattaacagccatttgctgactgcgcaaccttggatggacgatcttggaaccatgattagccagattgaagagatcgaacgtcatcttgcttaccttaaatggatttcacaaattgaagaactaagtgataacattcagcaatatctgatgaccaataatgtaccggaggcagcctccactctagtgtctatggcagaacttgacattaaacttcaggaatcatcttgtactcatcttcttggtttcatgagagccacagttaaattctggcataaaattctcaaggacaagcttacaagtgattttgaggaaattttagcacagcttcattggccattcatcgcaccccctcaatcacaaactgttggcttaagtcgacctgccagtgccccggagatatacagttacctggagacactgttttgtcagcttttgaaactacaaacctcagatgaattacttactgagccaaagcaactcccagaaaaatactctcttcctgcctccccttctgtcatcctgcccatccaggttatgctgactcctcttcagaagaggttcaggtatcacttcagagggaaccggcagactaatgtgttaagcaagccagaatggtacttggctcaagtacttatgtggattggaaaccatactgaatttctggatgagaagattcagccaatattagacaaagtaggctctttggtaaacgcaaggcttgaattttctcggggccttatgatgctggttcttgagaagttagccactgatattccttgtctgctatatgatgacaatctcttctgtcatttggtggatgaagtactcttgtttgaaagggagctacacagtgttcatggctatcctggcacttttgctagttgtatgcatattctatcagaggaaacctgttttcagagatggttgacggtggagagaaaatttgctcttcaaaaaatggactcaatgctttcctcagaagctgcctgggtatcgcaatataaggatatcactgacgtggatgaaatgaaagttccagattgtgcagaaacttttatgactctactcttggttataactgacaggtataaaaatcttcccacagcttcccgaaagcttcagttcctggagttacagaaggacttagtagatgattttaggatacgattaacacaagtgatgaaagaagagactagagcttcccttggctttcgatactgtgcaattcttaatgctgtgaactacatctcaacagtactagcagattgggctgacaatgttttctttctacaacttcaacaggctgcactggaggtgtttgcagagaataatactctgagtaaattgcagctaggacagctagcctctatggagagctctgtctttgatgacatgattaacctcttagaacgtttaaagcatgatatgttgacccgtcaagtagaccacgtttttagagaagttaaagatgctgcaaaattgtataaaaaagaaagatggttgtccttgccatctcagtcagagcaggcagtgatgtccctgtccagttcggcttgcccgttgctgctgacgttacgagaccatttacttcagttggagcagcagctttgtttctccttatttaaaattttctggcaaatgcttgtagagaagctggatgtatacatctaccaagaaataattcttgctaatcacttcaatgaaggaggagcagcccagctgcagtttgatatgactcggaatcttttccctttgttttctcactattgcaagagaccagaaaattattttaaacatataaaagaagcctgtattgttttgaatttgaacgtcggttctgcactactgctgaaagatgtactgcagtcagcttcagggcagcttcctgccacagcagcattaaatgaagttggaatttacaaactggctcaacaagatgttgagattctacttaatttgaggacaaattggcctaatactggaaaataatgtctttcagaaaaaggtttctttggtttttgtttctaagaaagaggaagccaattggatttcaagttatatgatgaaattctgaattaatgaaactggaaaactttatagaattacttattatcttggatttatggtgttattaaaatgctgaccatatttccttcatcctcttgttcctaaggaaacaaaaacagaaaacgaaacaatgaaaactcaattctatttacaagtataaatgctgagtatgtctgttgaagacgagcagagatattaaattataaccaactttcaatttcctgtgctaattaagggaaattctgttgtggataatcaaacatagccaataaatttttttaaaactccc

SEQ ID NO: 376381 - DNA, 2898 bp, Homo sapiens
tgagtggccgttccgacctccggtcaggagggggaggaacagagcacggccggcggctgcacgggcagggcctctctgggctgagaggaagaaaccagtgagacatcgagaggaagtcgctgtggcactcagtcctacggcctccgaggctgggtagtgagtgtgtcgctggccttagccagactccacaggccacgctggctgcgaatggagccgaggactcgcgcggaggcgagatgctaccagccggcgagatcggcgcctctcctgcagccccgtgctgctctgaaagtggtgacgaaaggaagaacctcgaggagaaaagtgacataaatgttacagttcttattggaagtaaacaagtcagtgaaggtacagataatggtgatctcccttcttatgtgtctgcattcatagaaaaggaagttggaaatgaccttaaatctttaaagaaacttgataaactcatagaacagaggacagtaagtaaaatgcagttagaagaacagtttctggagcaggaaactcatctcttcagcgccattaacagccatttgctgactgcgcaaccttggatggacgatcttggaaccatgattagccagattgaagagatcgaacgtcatcttgcttaccttaaatggatttcacaaattgaagaactaagtgataacattcagcaatatctgatgaccaataatgtaccggaggcagcctccactctagtgtctatggcagaacttgacattaaacttcaggaatcatcttgtactcatcttcttggtttcatgagagccacagttaaattctggcataaaattctcaaggacaagcttacaagtgattttgaggaaattttagcacagcttcattggccattcatcgcaccccctcaatcacaaactgttggcttaagtcgacctgccagtgccccggagatatacagttacctggagacactgttttgtcagcttttgaaactacaaacctcagatgaattacttactgagccaaagcaactcccagaaaaatactctcttcctgcctccccttctgtcatcctgcccatccaggttatgctgactcctcttcagaagaggttcaggtatcacttcagagggaaccggcagactaatgtgttaagcaagccagaatggtacttggctcaagtacttatgtggattggaaaccatactgaatttctggatgagaagattcagccaatattagacaaagtaggctctttggtaaacgcaaggcttgaattttctcggggccttatgatgctggttcttgagaagttagccactgatattccttgtctgctatatgatgacaatctcttctgtcatttggtggatgaagtactcttgtttgaaagggagctacacagtgttcatggctatcctggcacttttgctagttgtatgcatattctatcagaggaaacctgttttcagagatggttgacggtggagagaaaatttgctcttcaaaaaatggactcaatgctttcctcagaagctgcctgggtatcgcaatataaggatatcactgacgtggatgaaatgaaagttccagattgtgcagaaacttttatgactctactcttggttataactgacaggtataaaaatcttcccacagcttcccgaaagcttcagttcctggagttacagaaggacttagtagatgattttaggatacgattaacacaagtgatgaaagaagagactagagcttcccttggctttcgatactgtgcaattcttaatgctgtgaactacatctcaacagtactagcagattgggctgacaatgttttctttctacaacttcaacaggctgcactggaggtgtttgcagagaataatactctgagtaaattgcagctaggacagctagcctctatggagagctctgtctttgatgacatgattaacctcttagaacgtttaaagcatgatatgttgacccgtcaagtagaccacgtttttagagaagttaaagatgctgcaaaattgtataaaaaagaaagatggttgtccttgccatctcagtcagagcaggcagtgatgtccctgtccagttcggcttgcccgttgctgctgacgttacgagaccatttacttcagttggagcagcagctttgtttctccttatttaaaattttctggcaaatgcttgtagagaagctggatgtatacatctaccaagaaataattcttgctaatcacttcaatgaaggaggagcagcccagctgcagtttgatatgactcggaatcttttccctttgttttctcactattgcaagagaccagaaaattattttaaacatataaaagaagcctgtattgttttgaatttgaacgtcggttctgcactactgctgaaagatgtactgcagtcagcttcagggcagcttcctgccacagcagcattaaatgaagttggaatttacaaactggctcaacaagatgttgagattctacttaatttgaggacaaattggcctaatactggaaaataatgtctttcagaaaaaggtttctttggtttttgtttctaagaaagaggaagccaattggatttcaagttatatgatgaaattctgaattaatgaaactggaaaactttatagaattacttattatcttggatttatggtgttattaaaatgctgaccatatttccttcatcctcttgttcctaaggaaacaaaaacagaaaacgaaacaatgaaaactcaattctatttacaagtataaatgctgagtatgtctgttgaagacgagcagagatattaaattataaccaactttcaatttcctgtgctaattaagggaaattctgttgtggataatcaaacatagccaataaatttttttaaaactccc

SEQ ID NO: 376382 - DNA, 429 bp, Homo sapiens
attccttgtctgctatatgatgacaatctcttctgtcatttggtggatgaagtactcttgtttgaaagggagctacacagtgttcatggctatcctggcacttttgctagttgtatgcatattctatcagaggaaacctgttttcagagatggttgacggtggagagaaaatgtaagtgctgatgtggccagatggtagggagatatgtctgtttctgtgggtatacatttttgatatttttcttctccagttctaaataggaactagagccatttgaaatttccttttcagggttttctgtttccttcagagataatcttttctttacttcacatgaaacttccatttttcctgaaattacactctacatatttctagagtggaatagtcaagccagtggggtgtttgttttatagattttatcatat

SEQ ID NO: 376383 - DNA, 2981 bp, Homo sapiens
tgagtggccgttccgacctccggtcaggagggggaggaacagagcacggccggcggctgcacgggcagggcctctctgggctgagaggaagaaaccagtgagacatcgagaggaagtcgctgtggcactcagtcctacggcctccgaggctgggtagtgagtgtgtcgctggccttagccagactccacaggccacgctggctgcgaatggagccgaggactcgcgcggaggcgagatgctaccagccggcgagatcggcgcctctcctgcagccccgtgctgctctgaaagtggtgacgaaaggaagaacctcgaggagaaaagtgacataaatgttacagttcttattggaagtaaacaagtcagtgaaggtacagataatggtgatctcccttcttatgtgtctgcattcatagaaaaggaagttggaaatgaccttaaatctttaaagaaacttgataaactcatagaacagaggacagtaagtaaaatgcagttagaagaacaggtacttacaatttcatcagaaattcctaaaagaattcgaagtgccttaaaaaatgcagaagaatcaaagcaatttcttaatcagtttctggagcaggaaactcatctcttcagcgccattaacagccatttgctgactgcgcaaccttggatggacgatcttggaaccatgattagccagattgaagagatcgaacgtcatcttgcttaccttaaatggatttcacaaattgaagaactaagtgataacattcagcaatatctgatgaccaataatgtaccggaggcagcctccactctagtgtctatggcagaacttgacattaaacttcaggaatcatcttgtactcatcttcttggtttcatgagagccacagttaaattctggcataaaattctcaaggacaagcttacaagtgattttgaggaaattttagcacagcttcattggccattcatcgcaccccctcaatcacaaactgttggcttaagtcgacctgccagtgccccggagatatacagttacctggagacactgttttgtcagcttttgaaactacaaacctcagatgaattacttactgagccaaagcaactcccagaaaaatactctcttcctgcctccccttctgtcatcctgcccatccaggttatgctgactcctcttcagaagaggttcaggtatcacttcagagggaaccggcagactaatgtgttaagcaagccagaatggtacttggctcaagtacttatgtggattggaaaccatactgaatttctggatgagaagattcagccaatattagacaaagtaggctctttggtaaacgcaaggcttgaattttctcggggccttatgatgctggttcttgagaagttagccactgatattccttgtctgctatatgatgacaatctcttctgtcatttggtggatgaagtactcttgtttgaaagggagctacacagtgttcatggctatcctggcacttttgctagttgtatgcatattctatcagaggaaacctgttttcagagatggttgacggtggagagaaaatttgctcttcaaaaaatggactcaatgctttcctcagaagctgcctgggtatcgcaatataaggatatcactgacgtggatgaaatgaaagttccagattgtgcagaaacttttatgactctactcttggttataactgacaggtataaaaatcttcccacagcttcccgaaagcttcagttcctggagttacagaaggacttagtagatgattttaggatacgattaacacaagtgatgaaagaagagactagagcttcccttggctttcgatactgtgcaattcttaatgctgtgaactacatctcaacagtactagcagattgggctgacaatgttttctttctacaacttcaacaggctgcactggaggtgtttgcagagaataatactctgagtaaattgcagctaggacagctagcctctatggagagctctgtctttgatgacatgattaacctcttagaacgtttaaagcatgatatgttgacccgtcaagtagaccacgtttttagagaagttaaagatgctgcaaaattgtataaaaaagaaagatggttgtccttgccatctcagtcagagcaggcagtgatgtccctgtccagttcggcttgcccgttgctgctgacgttacgagaccatttacttcagttggagcagcagctttgtttctccttatttaaaattttctggcaaatgcttgtagagaagctggatgtatacatctaccaagaaataattcttgctaatcacttcaatgaaggaggagcagcccagctgcagtttgatatgactcggaatcttttccctttgttttctcactattgcaagagaccagaaaattattttaaacatataaaagaagcctgtattgttttgaatttgaacgtcggttctgcactactgctgaaagatgtactgcagtcagcttcagggcagcttcctgccacagcagcattaaatgaagttggaatttacaaactggctcaacaagatgttgagattctacttaatttgaggacaaattggcctaatactggaaaataatgtctttcagaaaaaggtttctttggtttttgtttctaagaaagaggaagccaattggatttcaagttatatgatgaaattctgaattaatgaaactggaaaactttatagaattacttattatcttggatttatggtgttattaaaatgctgaccatatttccttcatcctcttgttcctaaggaaacaaaaacagaaaacgaaacaatgaaaactcaattctatttacaagtataaatgctgagtatgtctgttgaagacgagcagagatattaaattataaccaactttcaatttcctgtgctaattaagggaaattctgttgtggataatcaacagcgaagggcggccttcgtggcctcgag

SEQ ID NO: 376384 - DNA, 2928 bp, Homo sapiens
tgagtggccgttccgacctccggtcaggagggggaggaacagagcacggccggcggctgcacgggcagggcctctctgggctgagaggaagaaaccagtgagacatcgagaggaagtcgctgtggcactcagtcctacggcctccgaggctgggtagtgagtgtgtcgctggccttagccagactccacaggccacgctggctgcgaatggagccgaggactcgcgcggaggcgagatgctaccagccggcgagatcggcgcctctcctgcagccccgtgctgctctgaaagtggtgacgaaaggaagaacctcgaggagaaaagtgacataaatgttacagttcttattggaagtaaacaagtcagtgaaggtacagataatggtgatctcccttcttatgtgtctgcattcatagaaaaggaagttggaaatgaccttaaatctttaaagaaacttgataaactcatagaacagaggacagtaagtaaaatgcagttagaagaacaggtacttacaatttcatcagaaattcctaaaagaattcgaagtgccttaaatctcttcagcgccattaacagccatttgctgactgcgcaaccttggatggacgatcttggaaccatgattagccagattgaagagatcgaacgtcatcttgcttaccttaaatggatttcacaaattgaagaactaagtgataacattcagcaatatctgatgaccaataatgtaccggaggcagcctccactctagtgtctatggcagaacttgacattaaacttcaggaatcatcttgtactcatcttcttggtttcatgagagccacagttaaattctggcataaaattctcaaggacaagcttacaagtgattttgaggaaattttagcacagcttcattggccattcatcgcaccccctcaatcacaaactgttggcttaagtcgacctgccagtgccccggagatatacagttacctggagacactgttttgtcagcttttgaaactacaaacctcagatgaattacttactgagccaaagcaactcccagaaaaatactctcttcctgcctccccttctgtcatcctgcccatccaggttatgctgactcctcttcagaagaggttcaggtatcacttcagagggaaccggcagactaatgtgttaagcaagccagaatggtacttggctcaagtacttatgtggattggaaaccatactgaatttctggatgagaagattcagccaatattagacaaagtaggctctttggtaaacgcaaggcttgaattttctcggggccttatgatgctggttcttgagaagttagccactgatattccttgtctgctatatgatgacaatctcttctgtcatttggtggatgaagtactcttgtttgaaagggagctacacagtgttcatggctatcctggcacttttgctagttgtatgcatattctatcagaggaaacctgttttcagagatggttgacggtggagagaaaatttgctcttcaaaaaatggactcaatgctttcctcagaagctgcctgggtatcgcaatataaggatatcactgacgtggatgaaatgaaagttccagattgtgcagaaacttttatgactctactcttggttataactgacaggtataaaaatcttcccacagcttcccgaaagcttcagttcctggagttacagaaggacttagtagatgattttaggatacgattaacacaagtgatgaaagaagagactagagcttcccttggctttcgatactgtgcaattcttaatgctgtgaactacatctcaacagtactagcagattgggctgacaatgttttctttctacaacttcaacaggctgcactggaggtgtttgcagagaataatactctgagtaaattgcagctaggacagctagcctctatggagagctctgtctttgatgacatgattaacctcttagaacgtttaaagcatgatatgttgacccgtcaagtagaccacgtttttagagaagttaaagatgctgcaaaattgtataaaaaagaaagatggttgtccttgccatctcagtcagagcaggcagtgatgtccctgtccagttcggcttgcccgttgctgctgacgttacgagaccatttacttcagttggagcagcagctttgtttctccttatttaaaattttctggcaaatgcttgtagagaagctggatgtatacatctaccaagaaataattcttgctaatcacttcaatgaaggaggagcagcccagctgcagtttgatatgactcggaatcttttccctttgttttctcactattgcaagagaccagaaaattattttaaacatataaaagaagcctgtattgttttgaatttgaacgtcggttctgcactactgctgaaagatgtactgcagtcagcttcagggcagcttcctgccacagcagcattaaatgaagttggaatttacaaactggctcaacaagatgttgagattctacttaatttgaggacaaattggcctaatactggaaaataatgtctttcagaaaaaggtttctttggtttttgtttctaagaaagaggaagccaattggatttcaagttatatgatgaaattctgaattaatgaaactggaaaactttatagaattacttattatcttggatttatggtgttattaaaatgctgaccatatttccttcatcctcttgttcctaaggaaacaaaaacagaaaacgaaacaatgaaaactcaattctatttacaagtataaatgctgagtatgtctgttgaagacgagcagagatattaaattataaccaactttcaatttcctgtgctaattaagggaaattctgttgtggataatcaaacatagccaataaatttttttaaaactccc

SEQ ID NO: 376385 - DNA, 411 bp, Homo sapiens
aactagcaccggtcacctcattctacgtagaagaaaagtgtaagtttagtaggtggaatcatggcagttcaggacttagtttagagatccgatcagtgattttagttaacacacataataacctaaggcttaatactatgaagagatacaaatgagtgactaaattactatccaaaacaacttaatgttttaaaaatgcctcaagatatctcagacagaaaacagtgaagacaggtacaagaaacccagggtggtgaagtttaacagatccatctgaaggtggaacctcctgcttcagagcctgaggtcatggctattattcagctttgcttctgcttggctacttccaggtaggagtcagaggtttggtgcactccttcctctgtctccctctcgttaacctgcagagcc

SEQ ID NO: 376386 - DNA, 478 bp, Homo sapiens
ggagaacatgaccatcaagttagtcttgtttttctaagcaaataggtgtgatcttgatgaattcatattgattaaataaatcaaacacatacaagcaaataaaatatcatgcaatcatttttcctgtcaatgagatgactcacacaacccccaattccaagggagatgaaagtgaggagcaatgcattgtcattgggagtatcaagggaaatcggacacaggaagatttataaatgagaattatgttttacttaatgcaactgcttcacaacagactctgagagagcatttttgcatgaattcagaatcctataggtataaaacatacctaatataggtgaaacagtgcttgaattaaagcaaatagtaaaatccaggagttgtgatttcttattccatgaagctgacaaatatgaagctgtagagaaaattttaaagatgaaattaagttaagcaattttattatcttcacagacaa

SEQ ID NO: 376387 - DNA, 418 bp, Homo sapiens
tcggtacccctctaccttgtctctcggctctaccttgtctctcggctctaccttgtctctcggctctaccttgtctctcggctctaccttgtcgctcggctctaccttgtctctcggctctaccttgtctctcggctctaccttgtctctcggctctaccttgtctctcggctctaccttgtctctcggctctaccttgtctctcggctctaccttgtccctcggctctaccttgtctcggctctaccttgtctcggctctaccttgtctcggctctaccttgtctctcggctctaccttgtcttagtaaaatccaggagttgtgatttcttattccatgaagctgacaaatatgaagctgtagagaaaattttaaagatgaaattaagttaagcaattttattatcttcacagacaa

SEQ ID NO: 376388 - DNA, 396 bp, Homo sapiens
tattgctaaatcaatgcctcctattagaagactgatatttctgttttagtggacgttctttaatctttattttccttatttcgaaacgtcttgttaaccctctttacgtagtcttactcataaaatattctaattctgtatttaacaagcggcattttattttagtgatagaaaaaactgtggctgaaccaagttttctgggatcactggaatgatgttagctaatggagtccaatgttgaaagcatttgttgcgcacctactggatgtcagacactttgcagacacgatcttatttctcctctgagcctaataataggtatcatttcccttaaatttcctcatgtgtagaattgaggcctatagatgttaagaacttgcccaagatccccatgca

SEQ ID NO: 376389 - DNA, 1199 bp, Homo sapiens
gatttataaccatttattagtgaaagtgtttttaagcacagtcagggtgtaaacagtgcagcattcctgctcccctccgtgggacatgcgtctccttttcaattcatgtgactacagaaggcacttggtgaactgtgcgtgtctgaggtgtggaaaccaggagagggggaaagaattctcaaaggcctgacgtgagaagttggaaaggtttgcaggttagggaatgaattgggagtgggggccggcggaccaattctcggtgactttctccccatttcatgtaaacagaattgccagggaccggttaccgtggatatgtttttctaaaaactcagtgtctgcacaatccattgatagaactggaggatgtgtctgtgtttcctgttgggtttttctcatctcttacatcatacaaaaccataccatatcccaccagagagtcgcagacactatgctgcctcccatggccctgcccagtgtatcttggatgctgctttcctgcctcatgctgctgtctcaggttcaaggtgaagaaccccagagggaactgccctctgcacggatccgctgtcccaaaggctccaaggcctatggctcccactgctatgccttgtttttgtcaccaaaatcctggacagatgcagatctggcctgccagaagcggccctctggaaacctggtgtctgtgctcagtggggctgagggatccttcgtgtcctccctggtgaagagcattggtaacagctactcatacgtctggattgggctccatgaccccacacagggcaccgagcccaatggagaaggttgggagtggagtagcagtgatgtgatgaattactttgcatgggagagaaatccctccaccatctcaagccccggccactgtgcgagcctgtcgagaagcacagcatttctgaggtggaaagattataactgtaatgtgaggttaccctatgtctgcaagttcactgactagtgcaggagggaagtcagcagcctgtgtttggtgtgcaactcatcatgggcatgagaccagtgtgaggactcaccctggaagagaatattcgcttaattcccccaacctgaccacctcattcttatctttcttctgtttcttcctccccgctgtcatttcagtctcttcattttgtcatacggcctaaggctttaaagagcaataaaatttttagtctgca

SEQ ID NO: 376390 - DNA, 1222 bp, Homo sapiens
gatttataaccatttattagtgaaagtgtttttaagcacagtcagggtgtaaacagtgcagcattcctgctcccctccgtgggacatgcgtctccttttcaattcatgtgactacagaaggcacttggtgaactgtgcgtgtctgaggtgtggaaaccaggagagggggaaagaattctcaaaggcctgacgtgagaagttggaaaggtttgcaggttagggaatgaattgggagtgggggccggcggaccaattctcggtgactttctccccatttcatgtaaacagaattgccagggaccggttaccgtggatatgtttttctaaaaactcagtgtctgcacaatccattgatagaactggaggatgtgtctgtgtttcctgttgggtttttctcatctcttacatcatacaaaaccataccatatcccaccagagagtgactcctgattgcctcctcaagtcgcagacactatgctgcctcccatggccctgcccagtgtatcttggatgctgctttcctgcctcatgctgctgtctcaggttcaaggtgaagaaccccagagggaactgccctctgcacggatccgctgtcccaaaggctccaaggcctatggctcccactgctatgccttgtttttgtcaccaaaatcctggacagatgcagatctggcctgccagaagcggccctctggaaacctggtgtctgtgctcagtggggctgagggatccttcgtgtcctccctggtgaagagcattggtaacagctactcatacgtctggattgggctccatgaccccacacagggcaccgagcccaatggagaaggttgggagtggagtagcagtgatgtgatgaattactttgcatgggagagaaatccctccaccatctcaagccccggccactgtgcgagcctgtcgagaagcacagcatttctgaggtggaaagattataactgtaatgtgaggttaccctatgtctgcaagttcactgactagtgcaggagggaagtcagcagcctgtgtttggtgtgcaactcatcatgggcatgagaccagtgtgaggactcaccctggaagagaatattcgcttaattcccccaacctgaccacctcattcttatctttcttctgtttcttcctccccgctgtcatttcagtctcttcattttgtcatacggcctaaggctttaaagagcaataaaatttttagtctgca

SEQ ID NO: 376391 - DNA, 603 bp, Homo sapiens
gggctgtacctggggctggaccatggatgctgggaaggggagtagttggccacaaagggaaggggaggcattggagggaaatccagaaagactggagattagagtgcccctggaaggacaggtagagagaaaatggccaaacatacatggaatgagagagaacaataggaaaagccttaacttgttattacattttaccaacctttagcacagtgcttggttcttaaggcagcagatgccctgcagagtgagcttaacacagacaactggtctacccactcccactgagtcatattctccaggttggggcttaaggagcagacagtgcaagccccagcagtgattctgatttccagccaggtctagaaaacaactgttttaagggaccagtcccatcagcccaccctaggtcccatcaaaaaggggctgagctctcctgactcccaggcccctgactgtcctcctggtttctttggctctcccagtactgagtctgccgttcactctcagggtgattttttaagtgtgcatcctgtctggctgcagcattaactcaactcagcagtgaacctccatcctggcctggctgcctctggctgcttt

SEQ ID NO: 376392 - DNA, 415 bp, Homo sapiens
attagctgtcaagcagccctcctaagacacacggactgaagcaaggactgcctccactcataaaaaaaaataacagttccttcactctcctcttggcctatagaaaatccatgtgagggccagactcggtggctcaagcctgtaatcccagcactttgggaggccgaggcaggcagattggttgaagccaggagtttgagaccaggctggccagcatgacaaaaccccatctctactaaaaatacaaaaattagctgggtgtcatggcaggcacctgtagtcccagctactcaggaggctgaggcacaagaatcacttgaacctggggggcagaggttgcagtgaaccaagatcgcaccactgcactgcagcctgggtgaaagagcaagacagtctccaaaaaaaagaaaaggta

SEQ ID NO: 376393 - DNA, 697 bp, Homo sapiens
ccgccccctcttcgggtgagcgacgttgccgcttgggtctgatacccgtcgcatccgagaccgaggccgaatccgggctctgggagggaccgggttagtggggccctagctcgggttgaaagaattttgttttgtcaattattgtaattgctaatgccatcaccatcacaatcgtcatcattaacatctattttaattaaaataatcatcccagagcgcagcagtttgtcccttttggctcctttggcgggagaacaaagcagcgggtttttttccgctacagccgttttctaagttgctgggtttgaggtaggaagagaaaatggagagaggcacggacacagagacttggtcataaggcaaacattaacccccagcgaacacgcaacattaaccccccgcgaacacgccgggaatggatggattcccctcttctttcctcccctcccctcttttggattagaagaggagaaagaaaatcttccgcattgtattgcaatccagggaagaattattcctatatgtccaccaaagccgcggcaaatagaaggaggccttcgcagttaatccaagacttcgatgtgtgatcataagcctgacgatttaggcaaaacaaattaaacaaaatccactaggaaaaaataaaagcaagctcaatcctgctacatccttgaaagtagtgtcgggtttgttttta

SEQ ID NO: 376394 - DNA, 467 bp, Homo sapiens
gcgcaattagtgataaaagcaccagatatcagagacactacacttatgtattgtaaaatatattgcttgtgaacctccttagtcttgtagcagtggtaattgttgcctggcctacaaggaaaacaattatagaagggaggaaaaaggcttaggaagctgaagctgcaggaggataatcactttataaaaaatgtatgttggctggaccattagggatttctctaactattttctcatgttgagtttgaggttccttctgaagagaatatttaaagagctgtcctctggatagctttctaacctcaggagaaataaacccacccaaagtaaaaaacaaacaactaagagcttctcaatggtacaggacttactctaggatattggatctaattttttacatgagtctttcaatggaaagcgaagcctgtattgggatactctatagaaagtgctgctttttgtcttgg

SEQ ID NO: 376395 - DNA, 577 bp, Homo sapiens
tgtttgcatatgatgcacgttttcctttcttccagctggatattcagttatgtccagtaccatttctttaaaaatccattttttccctctgagtttaaatatattaaattatcttttattctgggatgcatttgtcaattatcctctgctactgatgcagctatttttattgaatcactgtgctgtttggattataagtagctttataagatggcctaatatctagtgatgccagtttcccattatgattactgaaaaattgttttctggctcttcttgtgaatttagtcttctgtatatattttatgacatccaaatgaaagaaaagaaaaaagcaaaacaactcccccctgctcaccacccccaacaaaaatactttgtttgaatcctaattggaatgacactaggtttataaattaatttggggagaactgacattttttgtgatagcaagtcttcacattccaggacatgctatctattttatgtctttcaataacatcctatagtctgaactgggaaacccattcccaggactctactgcctagaaacatcactcctcacagtgacacaaaa

SEQ ID NO: 376396 - DNA, 686 bp, Homo sapiens
ttctgaaaccaacttccttaaactctcatgtataaggtagctatacacctaggatccctcttaaacacttactacttggttgggtaattctcatgaataacagaagcttgaaaattaacagagtattggattcagtgattgtacaagagcagtggagttttctccacaaagtagagaaaatcatttgtgtattgttatgcaaatagcttacagaactattaataattttgttttctttaatttgtaatttcttatgtaactagtccatttgctttcacccagtgatgagcatcttacctgcttcactcggtagcgctccattcctaatctttttaaggacaaattcatcaacttggcgttaaagtctatcagtaacatgatcccagctacttctccagattcctcttgagctgtccttactacatgtgcactacactgcagccacactgtgtgacttattccctggggtttctattgtttctgccttgcttttctcatcctttagatattagcattattggctgggcacagtggttcacacttgtaatcctagcactttgggaagctgaggcaggcagatcacttgagcccaggaattagagaccagcctgggcaacaaaaatgtcggctgcagtgagctgatactgctgtccaccctgggcaacagggtgtgagacctcatctca

SEQ ID NO: 376397 - DNA, 1326 bp, Homo sapiens
gagaccaaaaatgccatcattttcacctgcctgaactcttctgttgttttccctagttgctgccttgcgctttttccgcagtacagggagagaaatcagttgtctggctgtctaaactcacggcatctgcttagcagtttcaccagctcatagttgggactcatccctctgtcagaatcctttgctccattagaagggagactgggaccacgttcctgaattgatttgcatacttctacgttacctagctcagacaacatatggccatgtggagcacttggatttatttctgtttcctcaaattaaattcctaaaaaattggataactccacagtttgtttggtgttacaaaaaattttagttccttttttggtcggcaaagcaacacaattttggcattaaaaaaaaatctctggattactttaaaaagagtgttgatttgatttgcttcccctcttctcttacccctttcaggaaaaaaaaaaatgtatgttgaatcttaaaacactgcatcatgttgcaaaatgtccatttaggcacactgaatagaaagtatcatcgagtcatttttattcttgtaattcagtaatcttgtatcttttgcctttttctttttccttaatgttaattgtgtaactaaatgtctcaaacttgggacttttcactttacacatccatgtgtaaaaatacatagatacatacagtcagataggaaggaaataaggactcagtgttaataggatcagtgggttggggtgggggaactatacttaacaatagtatgttgtacatttcacagtagccaaaagagaacaattcaaatgttcttaacataaagaaaagataaatatatcaggtgataggcattctaattactctgatttgatcttcccacattatataaatgtatcaaattatcacgtactccccattaataatactgtatatcaacgaatttttttaaaaaaagaaatagatatcatacaatgaataactggattaatgtgaaatgatagaaaaagttaccattttaggctggatgtggtgacccacgcctgtaataccagtactttgtgagtctgaggcagtaggattgcttgaggccaggagtttgagaccagcctggttaacgatacaagaccccctttctaaaaaaaaaaaaaaaaaagccaagtgcagcagcatatgcctgtagtcccaactactgagggcatagaggtaggaggatcatggatcactggatcacttgaggagtttgaagttgcaggaagctatgatcctatcactgcactccagccgaggtgacagagcagcaagaccctgtct

SEQ ID NO: 376398 - DNA, 1339 bp, Homo sapiens
tggtcttgttttttaagagatggggtctcgcatactgtcgccaggctgagagtgcattagtgcaatcacagctcactgcagctttgaactcctgggctcaagggatcctcccacaacagcctcctgagtagctgggcctacaggtgtgtgccaccacgcctgactatttttacagtttttgtagaggcagggtctagctttgttgcccaggctggtctcaaacacctggcttcaagtgatcctcctgccttcaaagtgctgagcttacaggcatgagattttcttttcaattaaccaaaactaaaaagcacaaggaagcacaattttcaaacagttggcttagattacagggttgaagggagaggtggtggggagggaatcttaacacttccagcaccacactgcttaacttgttccaatgcacatgtggcatttttaaaatctcgtgaagtagaaagaggttatttctattataaaggcaaatgagcaaatgaacatttatttaaatgtctcacatcagaatatggaaagaaaggaaactgaagtgagttttataagaatcccttaagaaaacacacactctctgataaagcacatttctaggaacagggccaatttcctctgccttccactgtgaacggtaacatcacattcaagctgattctagaacacatccacctccgacagaaggcggggcagacaatgatgggagggtctgcagcacagacacaggctccttgaagacgcccgtggtgagatcagccccaggtcgccgcttccacagacaggccttttcctaaagtggatgaagggagtcaaataggccagcttcgtgtcttgatctgcctttgctgtcattcacgcatctgtcctcatgaaggcttaacctaccatgtttatcagaaatctcagcctaaattcattcgatttttacctagagatgaggaatgtgttaaatcactctactccacaaggaaccaaaccaaacagcatcagcaccaggctgagtcgcggaaaggatctgtcagaccgctccactggcatcgactcagctcgggagctacgttcaaagaaggaggacatttaaggtgaaagggttgcaggcagaggggcctggagcagcaggaggccacctcccaaaggctccactcccaggggccaacagagagaccacatccagaattgaaccagggatacgcagacaccaacggagaagacatgagcgtcaacctcctccacggagcagcacggcttctctactgacatccatgaactagactacaactctctaagttaatcaaatttactaagttagttatcaccgacatcactgttccat

SEQ ID NO: 376399 - DNA, 411 bp, Homo sapiens
ccgtgacactctgcagccaggtgctggggcgcgagagcaaggcactgcagttccgtcactccacacaatttctcactgtaaaactgacatgaagtcctccaatcttgacgtgatgccttaacgtatactgttcaattaaaaacatttcattctacgccgtttatatcacagttacatatttatatttcatatcatattatatcataggaatgtgttaaatcactctactccacaaggaaccaaaccaaacagcatcagcaccaggctgagtcgcggaaaggatctgtcagaccgctccactggcatcgactcagctcgggagctacgttcaaagaagggtgagttgcccgggaggagaccacccagagcagtagccctcttcctgggcacagggaagacgcaccccatacc

SEQ ID NO: 376400 - DNA, 1420 bp, Homo sapiens
tggtcttgttttttaagagatggggtctcgcatactgtcgccaggctgagagtgcattagtgcaatcacagctcactgcagctttgaactcctgggctcaagggatcctcccacaacagcctcctgagtagctgggcctacaggtgtgtgccaccacgcctgactatttttacagtttttgtagaggcagggtctagctttgttgcccaggctggtctcaaacacctggcttcaagtgatcctcctgccttcaaagtgctgagcttacaggcatgagattttcttttcaattaaccaaaactaaaaagcacaaggaagcacaattttcaaacagttggcttagattacagggttgaagggagaggtggtggggagggaatcttaacacttccagcaccacactgcttaacttgttccaatgcacatgtggcatttttaaaatctcgtgaagtagaaagaggttatttctattataaaggcaaatgagcaaatgaacatttatttaaatgtctcacatcagaatatggaaagaaaggaaactgaagtgagttttataagaatcccttaagaaaacacacactctctgataaagcacatttctaggaacagggccaatttcctctgccttccactgtgaacggtaacatcacattcaagctgattctagaacacatccacctccgacagaaggcggggcagacaatgatgggagggtctgcagcacagacacaggctccttgaagacgcccgtggtgagatcagccccaggtcgccgcttccacagacaggccttttcctaaagtggatgaagggagtcaaataggccagcttcgtgtcttgatctgcctttgctgtcattcacgcatctgtcctcatgaaggcttaacctaccatgtttatcagaaatctcagcctaaattcattcgatttttacctagagatgaggaatgtgttaaatcactctactccacaaggaaccaaaccaaacagcatcagcaccaggctgagtcgcggaaaggatctgtcagaccgctccactggcatcgactcagctcgggagctacgttcaaagaaggggcatggtgctattcctggcttcaggcatctgctggagtgcagtggcaccgtcacagctcactgcagcctcaagcaatcctccagcctcagcctcctcagtagccgggactaccaggactacaccaccacacttggttttgaaccatatttcaagataacccgatagcccagctgatgtggagctcttctttgaagaagtccagcaaacaaatgaagaagttacagaactagaaaacttcgcaaactctaataaagtaattgattcaggcaataatcctcaatgaatatgaaaaccattaataggttgatgaggaactcattatcacaggacaccagaaactca

SEQ ID NO: 376401 - DNA, 733 bp, Homo sapiens
aaactaaaaagcacaaggaagcacaattttcaaacagttggcttagattacagggttgaagggagaggtggtggggagggaatcttaacacttccagcaccacactgcttaacttgttccaatgcacatgtggcatttttaaaatctcgtgaagtagaaagaggttatttctattataaaggcaaatgagcaaatgaacatttatttaaatgtctcacatcagaatatggaaagaaaggaaactgaagtgagttttataagaatcccttaagaaaacacacactctctgataaagcacatttctaggaacagggccaatttcctctgccttccactgtgaacggtaacatcacattcaagctgattctagaacacatccacctccgacagaaggcggggcagacaatgatgggagggtctgcagcacagacacaggctccttgaagacgcccgtggtgagatcagccccaggtcgccgcttccacagacaggccttttcctaaagtggatgaagggagtcaaataggccaggtgggaaatcaaggaaggagtgggcgtgttcccaggggctgtggtgggagaagtcacgaccatctcgtgtgggtcctccaggagaaacccagcgccactcgggtggctggggcgccgtcagccgggactagcgaggctggagtcagaccctgggggacggagtctccaccagcaccggcagggatggcgttccatccgtcca

SEQ ID NO: 376402 - DNA, 519 bp, Homo sapiens
  misc_feature (442)..(442): n is a, c, g, or t
  misc_feature (472)..(472): n is a, c, g, or t
  misc_feature (478)..(478): n is a, c, g, or t
aggaggattcagaatttaggttggggaagaaaagggcaagggtttcatttgtccctgtgctgctgtcttctgggactctctgaggggtaagacggtggtgggcacacacagccaaaggaagtaggggtacaggggagtgcgactctgagtatggagtttattacttggcaggaagcacttctgatctttaacacatgcccgtaaatgccgttgggaagatttgttaataaaattatgcgatgagattcccagagacctgcattgctttctcctggttttatttaacaatcgacaaatgaaattcttacagcctgaaggcaggacgtgtccccagatgtgaaagagaccttcagtatcagccctaactcttctctcccagggaaggacttgctgggctctgtggccagctgtccagcccagccctgtgtgtgaatcgtttgtngacgtgttgcaaatggggaaagggaggggntttttnacatcttccttaaagggacctggatggccaacacaagttgg

SEQ ID NO: 376403 - DNA, 356 bp, Homo sapiens
  misc_feature (17)..(17): n is a, c, g, or t
  misc_feature (305)..(305): n is a, c, g, or t
  misc_feature (322)..(322): n is a, c, g, or t
tcagactgtggctgttnaaggatgatggtgatagtaggttttgttaaacctgagagcctgacaaatggtgaatcacaatggctgatctgagttaatggaaattgaactacggccacttctagtaaaccacgtcgtgcctcactgggtcctgcttacctcatttctgaatgtgcatttccagccttcttgctctcagagctattgttcaagcagaaaacaagctgcttttattacagtaaggtgaagacctggttggaattggtaatgaaatgccaaacaactcaccactcgaagtcccaattggnacagacacagggttctnagaccactgatcctgagtggtctcggcccagggc

SEQ ID NO: 376404 - DNA, 2820 bp, Homo sapiens
aacaaagtcggagtttgtggattgggggaagggcggggtctaacctcaggtcaggcgccgtgcaaggtacatcttggcacccggaagaggcccagtacagttgcccccgaggtgacccgacctcccctaccaattgaggcgcccttgttgccaggcttgcggcgggggagcggcgggggagcgacggggatgcgctcattggtcaaggaaggggcgcctgttactagaggcgagaaccggagcccattggtcggaacacctcacaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagtaaaaaaaaaaagaaaaagccccggggaacacacactatacggggtggcggaaacaagagggtcatgaactgggcccctgggcacatcacggggttcccggacccacgttttgtggaccaagggggaactctccgcggacccccaaaagggagcgaataaccgaataaccaggtaccctgatatgaactcggaaa

SEQ ID NO: 376405 - DNA, 2921 bp, Homo sapiens
aacaaagtcggagtttgtggattgggggaagggcggggtctaacctcaggtcaggcgccgtgcaaggtacatcttggcacccggaagaggcccagtacagttgcccccgaggtgacccgacctcccctaccaattgaggcgcccttgttgccaggcttgcggcgggggagcggcgggggagcgacggggatgcgctcattggtcaaggaaggggcgcctgttactagaggcgagaaccggagcccattggtcggaacacctcacaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtaattgtgtatctgcccattgttcgttgcctcattaacttggctttctaggtgcacccaccttgccaccagagaagtccaaatcctgacttctctccaaggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagtaaaaaaaaaaagaaaaagccccggggaacacacactatacggggtggcggaaacaagagggtcatgaactgggcccctgggcacatcacggggttcccggacccacgttttgtggaccaagggggaactctccgcggacccccaaaagggagcgaataaccgaataaccaggtaccctgatatgaactcggaaa

SEQ ID NO: 376406 - DNA, 2989 bp, Homo sapiens
aacaaagtcggagtttgtggattgggggaagggcggggtctaacctcaggtcaggcgccgtgcaaggtacatcttggcacccggaagaggcccagtacagttgcccccgaggtgacccgacctcccctaccaattgaggcgcccttgttgccaggcttgcggcgggggagcggcgggggagcgacggggatgcgctcattggtcaaggaaggggcgcctgttactagaggcgagaaccggagcccattggtcggaacacctcacaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtaactgcaccacctgtttactgcatcgccccagtgccagggtctgcctgaccagctggctgccctctcctgctatgagagccaacagcacaggctcactggccttgtgccttctgaggcccaagtcccagatgcttggggtcttagttctacttctcccatccccagggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagtaaaaaaaaaaagaaaaagccccggggaacacacactatacggggtggcggaaacaagagggtcatgaactgggcccctgggcacatcacggggttcccggacccacgttttgtggaccaagggggaactctccgcggacccccaaaagggagcgaataaccgaataaccaggtaccctgatatgaactcggaaa

SEQ ID NO: 376407 - DNA, 2529 bp, Homo sapiens
aacaaagtcggagtttgtggattgggggaagggcggggtctaacctcaggtcaggcgccgtgcaaggtacatcttggcacccggaagaggcccagtacagttgcccccgaggtgacccgacctcccctaccaattgaggcgcccttgttgccaggcttgcggcgggggagcggcgggggagcgacggggatgcgctcattggtcaaggaaggggcgcctgttactagaggcgagaaccggagcccattggtcggaacacctcacaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctc

SEQ ID NO: 376408 - DNA, 2923 bp, Homo sapiens
aacaaagtcggagtttgtggattgggggaagggcggggtctaacctcaggtcaggcgccgtgcaaggtacatcttggcacccggaagaggcccagtacagttgcccccgaggtgacccgacctcccctaccaattgaggcgcccttgttgccaggcttgcggcgggggagcggcgggggagcgacggggatgcgctcattggtcaaggaaggggcgcctgttactagaggcgagaaccggagcccattggtcggaacacctcacaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctgggtgagtgtatgcatgtgtgtgtgtgtatgtggggcagggacacagagaccagaggcccgtacagggactcccccgacctgccctctcctcgcctcttgaccagtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagtaaaaaaaaaaagaaaaagccccggggaacacacactatacggggtggcggaaacaagagggtcatgaactgggcccctgggcacatcacggggttcccggacccacgttttgtggaccaagggggaactctccgcggacccccaaaagggagcgaataaccgaataaccaggtaccctgatatgaactcggaaa

SEQ ID NO: 376409 - DNA, 1764 bp, Homo sapiens
gctggctgtctacctcgtcctccctgcccacagaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagtaaaaaaaaaaagaaaaagccccggggaacacacactatacggggtggcggaaacaagagggtcatgaactgggcccctgggcacatcacggggttcccggacccacgttttgtggaccaagggggaactctccgcggacccccaaaagggagcgaataaccgaataaccaggtaccctgatatgaactcggaaa

SEQ ID NO: 376410 - DNA, 1364 bp, Homo sapiens
aacaaagtcggagtttgtggattgggggaagggcggggtctaacctcaggtcaggcgccgtgcaaggtacatcttggcacccggaagaggcccagtacagttgcccccgaggtgacccgacctcccctaccaattgaggcgcccttgttgccaggcttgcggcgggggagcggcgggggagcgacggggatgcgctcattggtcaaggaaggggcgcctgttactagaggcgagaaccggagcccattggtcggaacacctcacaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagtaaaaaaaaaaagaaaaagccccggggaacacacactatacggggtggcggaaacaagagggtcatgaactgggcccctgggcacatcacggggttcccggacccacgttttgtggaccaagggggaactctccgcggacccccaaaagggagcgaataaccgaataaccaggtaccctgatatgaactcggaaa

SEQ ID NO: 376411 - DNA, 1042 bp, Homo sapiens
aacaaagtcggagtttgtggattgggggaagggcggggtctaacctcaggtcaggcgccgtgcaaggtacatcttggcacccggaagaggcccagtacagttgcccccgaggtgacccgacctcccctaccaattgaggcgcccttgttgccaggcttgcggcgggggagcggcgggggagcgacggggatgcgctcattggtcaaggaaggggcgcctgttactagaggcgagaaccggagcccattggtcggaacacctcacaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtaattgtgtatctgcccattgttcgttgcctcattaacttggctttctaggtgcacccaccttgccaccagagaagtccaaatcctgacttctctccaaggtgttgggaattctgtgccctaaagaattccgactcagatccgaacggggatctggtggaatcgagggtgaaagaccagagggacaatgttctactatcccaacgtgcttcagcgccacaccggctgctttgccaccatctggtaagggcggggcccgttggcgcgcgatggcggacgctgcccgggatcccagcctgacagctcc

SEQ ID NO: 376412 - DNA, 249 bp, Homo sapiens
gtaaggctgggaaccctcaaaggtggggcgggctgagcagctgtctgctaagctggctgtctacctcgtcctccctgcccacagaggacatccagcacatcttggagcgcctccaccgtgcccagctgcagatccgaatagatatggagactgagctgtgagtgtgccctgggcctttgatggaacacctgctagcttggcctcagcctggctcagcctcagtccttcacggcctacattctctcccag

SEQ ID NO: 376413 - DNA, 354 bp, Homo sapiens
ccatgatggagaccctagaagatgctccagatcccttttttgggatgatgtctgtggatcccagacttcctagtcctttcgatatccctcaggtagggctcattccccaagactcgtgaattggcaatgcagaaggggagtgctgtccctgtgtcactctgacattggggttggggaaggaagcttaccacagctctctcccacaggagatggtgcagggggactgccaaggtggacccatccaggcgaagccccctgtacttacctactcagggccaatctgatcagacggtttccccactggaggcagctcttgtccccacttgtctccacactgttttcactgccaaggcc

SEQ ID NO: 376414 - DNA, 411 bp, Homo sapiens
ttgccaccatctggtaagggcggggcccgttggcgcgcgatggcggacgctgcccgggatcccagcctgacagctccccctccatccccattctcccaccttccccacccacttcaggctggcggcgactcgcggcagccggttggtgaagcgcgaatacctgagggtgaatgtggtgaaaacctggtaaggcccagaaaagggaaggagggcctggtgcggggggtgagttaggggatggggtggccaagactgtgggcccactcctggacgcagcggtaatcagggcgcattgttccccagcgaggaaatcctcaattacgtgctggtacgagtgcaacccccgcagcccggcctgccgcggccccgcttctccctctatctctcagcccaacttcagatcggtgtgat

SEQ ID NO: 376415 - DNA, 316 bp, Homo sapiens
ccaggggcttttctgggagtacctggatactgctgcagacaagggctttatatcccaacttgctaaagggaggaccctgcagtttcttgccctggcatctgcaaggggtaaggggcttatgggacagagccccttgggtgttgttgcagaggtgacccccccggaggagctgcgtctgccagccccacccagcccagaggtgagtagcctcccttctaatcctcctcctcctcctctttgccctcccccacaaggactgcctccccaagcccagggccactgctagcttacaggggtccttaatgcagatgataaa

SEQ ID NO: 376416 - DNA, 292 bp, Homo sapiens
taactgcaccacctgtttactgcatcgccccagtgccagggtctgcctgaccagctggctgccctctcctgctatgagagccaacagcacaggctcactggccttgtgccttctgaggcccaagtcccagatgcttggggtcttagttctacttctcccatccccagggtcccgagggaggccctggagcccagtgttccccttatggtgtctttaggtaagcacctagagaagaggcgcagtgggaccacaccctaaccactgtcccaggaaactagtatcccaactgctg

SEQ ID NO: 376417 - DNA, 424 bp, Homo sapiens
gcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtaattgtgtatctgcccattgttcgttgcctcattaacttggctttctaggtgcacccaccttgccaccagagaagtccaaatcctgacttctctccaaggtgttgggaattctgtgccctaaagaattccgactcagatccgaacggggatctggtggaatcgagggtg

SEQ ID NO: 376418 - DNA, 886 bp, Homo sapiens
  misc_feature (46)..(46): n is a, c, g, or t
aaaccgaaaattatcggcggcaaggatgctgaagtgccccttgggngtgtttaaaaattcggccacgagggtctgaggagctggttgcctgacaggctggaacctggggccctactcatgaggtgacccccccggaggagctgcgtctgccagcccaccaccaaaggagcccgtccactcctcgggtcgtcggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgacggtcggaggacgcgccaggaagctccttgcaattagcccaggtggatgccatagaaagtcccattgaaggctgcccatgggacgattcgcctctttggcgggcttgccccccaagagactcagaagttgatctcaacttggaagcagctgcaccatgggcgaggtgccattggagcttcgaggctaaacggaggagcccgattttacggaggactggtgtcacgctctcagcccccgcgagcatgcgacgcccgggtctccaacccaggcgca

SEQ ID NO: 376419 - DNA, 3152 bp, Homo sapiens
aacaaagtcggagtttgtggattgggggaagggcggggtctaacctcaggtcaggcgccgtgcaaggtacatcttggcacccggaagaggcccagtacagttgcccccgaggtgacccgacctcccctaccaattgaggcgcccttgttgccaggcttgcggcgggggagcggcgggggagcgacggggatgcgctcattggtcaaggaaggggcgcctgttactagaggcgagaaccggagcccattggtcggaacacctcacaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagaggtgagtagcctcccttctaatcctcctcctcctcctctttgccctcccccacaaggactgcctccccaagcccagggccactgctagcttacaggggtccttaatgcagatgataaaagatgcccctttctacgccccatcgtatctggcctacgcttcccagatgggtacccttatgcaaggtatgagctgctcaagtgcatggagaccccgcacaagccctctccaggttcctctaggggcgggtgtggggtcctgttagcagtccaccagaatgacaggaaaaggagtaatgggcagccttgcccctacctgccctccccactcaacagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagtaaaaaaaaaaagaaaaagccccggggaacacacactatacggggtggcggaaacaagagggtcatgaactgggcccctgggcacatcacggggttcccggacccacgttttgtggaccaagggggaactctccgcggacccccaaaagggagcgaataaccgaataaccaggtaccctgatatgaactcggaaa

SEQ ID NO: 376420 - DNA, 3233 bp, Homo sapiens
aacaaagtcggagtttgtggattgggggaagggcggggtctaacctcaggtcaggcgccgtgcaaggtacatcttggcacccggaagaggcccagtacagttgcccccgaggtgacccgacctcccctaccaattgaggcgcccttgttgccaggcttgcggcgggggagcggcgggggagcgacggggatgcgctcattggtcaaggaaggggcgcctgttactagaggcgagaaccggagcccattggtcggaacacctcacaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaatcccgcggctcccacctccagctcctgcagagtaagggcaagaactcctagaccaggtagggtgtcagtgctgggaagggtctcctcatttctcttgcccatttcccctcagggtggaaggaataggagaggcactgggtcctgaggagctgaggctgacaggctgggaacctggggccctactcatggaggtgacccccccggaggagctgcgtctgccagccccacccagcccagaggtgagtagcctcccttctaatcctcctcctcctcctctttgccctcccccacaaggactgcctccccaagcccagggccactgctagcttacaggggtccttaatgcagatgataaaagatgcccctttctacgccccatcgtatctggcctacgcttcccagatgggtacccttatgcaaggtatgagctgctcaagtgcatggagaccccgcacaagccctctccaggttcctctaggggcgggtgtggggtcctgttagcagtccaccagaatgacaggaaaaggagtaatgggcagccttgcccctacctgccctccccactcaacagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagtaaaaaaaaaaagaaaaagccccggggaacacacactatacggggtggcggaaacaagagggtcatgaactgggcccctgggcacatcacggggttcccggacccacgttttgtggaccaagggggaactctccgcggacccccaaaagggagcgaataaccgaataaccaggtaccctgatatgaactcggaaa

SEQ ID NO: 376421 - DNA, 2795 bp, Homo sapiens
aacaaagtcggagtttgtggattgggggaagggcggggtctaacctcaggtcaggcgccgtgcaaggtacatcttggcacccggaagaggcccagtacagttgcccccgaggtgacccgacctcccctaccaattgaggcgcccttgttgccaggcttgcggcgggggagcggcgggggagcgacggggatgcgctcattggtcaaggaaggggcgcctgttactagaggcgagaaccggagcccattggtcggaacacctcacaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctgaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagtaaaaaaaaaaagaaaaagccccggggaacacacactatacggggtggcggaaacaagagggtcatgaactgggcccctgggcacatcacggggttcccggacccacgttttgtggaccaagggggaactctccgcggacccccaaaagggagcgaataaccgaataaccaggtaccctgatatgaactcggaaa

SEQ ID NO: 376422 - DNA, 1728 bp, Homo sapiens
  misc_feature (1715)..(1715): n is a, c, g, or t
aacaaagtcggagtttgtggattgggggaagggcggggtctaacctcaggtcaggcgccgtgcaaggtacatcttggcacccggaagaggcccagtacagttgcccccgaggtgacccgacctcccctaccaattgaggcgcccttgttgccaggcttgcggcgggggagcggcgggggagcgacggggatgcgctcattggtcaaggaaggggcgcctgttactagaggcgagaaccggagcccattggtcggaacacctcacaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaacatcacgcggctccactgccggctactcagaggtgtaagaataggagacgctgatgcgatcatgaggcacgtgagcatgtcagactgggaaacatcgggaccataattatggagtagactcacatcggatgaattcgaatgggacagctgaagacaagagaagaaggtgagtatcataccttttaatntcggtgcctcctg

SEQ ID NO: 376423 - DNA, 821 bp, Homo sapiens
gctgggatgggtatgccccttgtcactgtcacagctgccaccttccctactctctcatgtcctcctagggcctggcctgaggtggaggcgccagaagctcctgcattgcccgtggtgcctgaactccctgaggtgcccatggagatgcctttggtgctgcccccagagctcgagctgctctcactggaagcagtgcacaggtaccagggaggtggcaccttgatggggtggacccgggctgaagcctctgctaatggttcttgatccctatagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagtaaaaaaaaaaagaaaaagccccggggaacacacactatacggggtggcggaaacaagagggtcatgaactgggcccctgggcacatcacggggttcccggacccacgttttgtggaccaagggggaactctccgcggacccccaaaagggagcgaataaccgaataaccaggtaccctgatatgaactcggaaa

SEQ ID NO: 376424 - DNA, 512 bp, Homo sapiens
tcttgcttctgccctttccattgccatccctgtttctcaaggggtgagttcagatctgctattcccgttttccatgggaaccagtgactgacaggacctgttgctgacgtgctgcggagacatacatggtgctcacaaaggggcacccttctttttttttctcttttttttttttttttttttttgagacagggcctcactccaatttgcccaggctggagtacagtagcacaattttggcttactgcagcctcgacctcctgggctcaggtgattttcccacctcagccttccaagtagctgggaccacaggtgtatgccaccacacctggctactttttgtgtgtgtgtattgtagagacgggggtttcaccatgttgcctagactggtcttgaactcctgagctcaggtgatccacctgccttggcttcccgaagagctgggattacaggcatgagccaccatgcccggcccagagggcacccttctaacaaccccactgcccgtctgc

SEQ ID NO: 376425 - DNA, 661 bp, Homo sapiens
ggagacagtctggggtgtctggagaatcctcccccacttctgcttaccccaggtcgctgtgggagcaggtgtctcaggaaatggggcctgggtcccacccaaggcctcgggtctgagttagatgtctgtatgtttgttgttgcccctgcaacaaagtaccacagattgagtagtttaagccacatgcatgttatctcacagttcggggggtcgggaatctaaactgggttggcagggctgatgccttctggaggcaagggagctgtttcccagcgtttccagctcctagaggctgctagctagtggccctttcctttgtcttcaaagccggcagcacagccttttctaacctctcccactccaggtcatttcacatcaactctttctgcctccctcttgtaagtgtgataccctaccttgttttaacctgaattgactgtcccttagctgagagagccagacacactccattttggctccttcacttgcagccccttacccaccccccttcctcaaggacttaacttgtgcaagctgactcccagcacatcaaagaatgcaattaatggataagatactgtgggcaagctatatccgcagttcccagggaattttgcccagttggatagttacccttaaggcccccacatttgtgtccggt

SEQ ID NO: 376426 - DNA, 651 bp, Homo sapiens
gatctgtacatgtctcccaaaaaggagcacagagacattgtaaggagagactctatgtccttgagaagcatttctgtgtaatggcttatttcctctgtggtcttcttttaggtgatctctctgtgggtttaaattaaagtgtaaataatctttggccgggcgcggtggctcacgcctgtaatcccagcactttgggaggcagaggcgggcggatcatgaggtcaggagatcgagaccgtcctggctaacacgatgaaaccccgtctctactaaaaatacaaaaaattagccgggcgtggtggcgggcgcctgtagtcccagctactcgggaggctgaggcaggagaatggcgtgaacctgggaggtggagcctgcagtgagccgagatcgcgccactgcactccagcctgggcgacagagcgagactccgtctcaaaaaaaaaaaacaaaaagtaaataatctttgtgctggtatacctctgttaggctgaatttggttgtgcatagaattacacttgatttttgtagtacaaagttactagttttactcagattagtagagcatagcttttttccaatatggctggaaatacttttaagtgtgcatttagttttgaaagattttatttcttatacatattttatcttcta

SEQ ID NO: 376427 - DNA, 308 bp, Homo sapiens
agccatgacttctacttcaaactgcttgctctgttgatccaagtggagaacctctttccatatcagaagccagtcttggccatccccctacctaacctcactcagcctttaataagcaggtaatggcatctgcttccagggaggaagatgctccgtgatgactggtctttaaggacagaagagtgggccaacgtgttgatgttttagaccatttgtgttactatcaaggcatacctgaggctgggtaatttataaagtaaataggttcaattggctcgtgattctgccgactggaagattaggcatgt

SEQ ID NO: 376428 - DNA, 4220 bp, Homo sapiens
gggtcctgtagggatcccagctggggaaggtgcaggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccagggggagcaaaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctta

SEQ ID NO: 376429 - DNA, 6213 bp, Homo sapiens
  misc_feature (1293)..(1293): n is a, c, g, or t
  misc_feature (3275)..(3276): n is a, c, g, or t
  misc_feature (3349)..(3349): n is a, c, g, or t
  misc_feature (3365)..(3365): n is a, c, g, or t
  misc_feature (3410)..(3410): n is a, c, g, or t
gggtcctgtagggatcccagctggggaaggtgcaggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcgggtaggtcgggtactgggccagtggccatgcccagctcttgcggcggtctgctgggttgcggggctggctgcacccagtgtgaggccctgtctgctcacagaggcctcattgcagagagccacttcggccagccgctcgcagccgagctacaccgtgcacctccacctcctgcagcagcttgtgtcccacgaggtcacccagcacgagctcctggggctgggcgnagccggggctgcccttcaggtcctgacactcctccacctgctcccctcaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcaggtctgtagcagcccctgccctgggcgcgctcgcacctccccctctcctcccacggcccctccttcctgggccccagcatccgttctgaggggtgtagcagcccctgccctgggcgcgctcgcacctccccctctcctcccacggcccctctttcctgggcctcagcatccgttctgaggggtggaggtgaatccctttggtgacctcccttatgggtgcaacaggctctgctaaggctcgctgcagggacggggagcttgccacttctcaggcctccccatttcctgctgcctagctctgagtgctttgagttcttccttaggctgagcaaaatctacctgtcctttctcctttagtcccaggcctgtcttcagggcctccctgcctgctcctctgcccccattaggttacaggtggtcctgcccacggtgcaggnngaacttctagctagggtgtcttatagcagggacccagcatgccaggcaacaggcggtggagtccagcacatgngctctggaccacctgngttcagactccggcttcatcactgcttagcagccttgggcaagtncccggtgcagatgagagtagttctggcttctgttgaggattaaatgggtcatgtgaggtgctgagcgtggtgtcagtacaaaggaagtggtcagtgactattagcggtagtgacgatgatgatgacagcgccccacctccctgtggaatctgggccctgaagagccgcagccctcctagagttctgttccacccccagaggtataagccagggcccctcggagcccggccgtttttatttcttaaaccatgtatatatattttttatttttttgagacggagtctcgctctgtcgcccaggctggagtgcagtggcgcgatctcagctcactgcaacctccgctccgggttcaagtgattccctgcctcagcctgctgagtaactgggactacaggtgcatgccattatgcctggctaattgtttttttgagatggagtcttgctctgttgccaggccagagtgcagtggtgcaatcttggctcactgcaacctccgcctcctgggttcaagcgattctcctgcctcagcctcccaagtagctgggactacaggcacgtgccacaatgcctggctaatttttgtatttttagtagagacgggtttcaccatgttggccaggatggtctcaatctcttgacctcctgatccacccacctcgacctcccaaagtgctgggattacaggcgtgagccaccacgcccggcctggttctgtcttaaatcatggttgtcactgggggcctggcctcctccctgtctccagccttgtttgtgcattccgttagtgtgctggggagggttcctcactgaggttgagaggtgtgttggataggactgatcccacctgccccttgctggtcctgtacccaccctctccccagcctcacctggggtgggaggcggagggggaggttgggggtgggaggagctggggtggggctgggtcactgaggccgcccctttctcaagagcgtctttgcttcctcctccgccaccgccctgccgtgctgtgtccgcatccctccggccccgccccagcctcctgaccctgctctggacccacacactcacagtgctggtggaggcggccgctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccagggggagcaaaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctcttaaaatatgcctttggcctacagtggggcctggaatgcgagccaggccgggtagcttcctccccagccctcaggggactttgagctaccgccaccttggggtagctacaaagcaggggggtaggtgtggaaataactgaggcagaggcagggctagggtgatttttggccgtgggctttgaataaattgctttaccaggcaaac

SEQ ID NO: 376430 - DNA, 5957 bp, Homo sapiens
  misc_feature (1293)..(1293): n is a, c, g, or t
  misc_feature (3275)..(3276): n is a, c, g, or t
  misc_feature (3349)..(3349): n is a, c, g, or t
  misc_feature (3365)..(3365): n is a, c, g, or t
  misc_feature (3410)..(3410): n is a, c, g, or t
gggtcctgtagggatcccagctggggaaggtgcaggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcgggtaggtcgggtactgggccagtggccatgcccagctcttgcggcggtctgctgggttgcggggctggctgcacccagtgtgaggccctgtctgctcacagaggcctcattgcagagagccacttcggccagccgctcgcagccgagctacaccgtgcacctccacctcctgcagcagcttgtgtcccacgaggtcacccagcacgagctcctggggctgggcgnagccggggctgcccttcaggtcctgacactcctccacctgctcccctcaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcaggtctgtagcagcccctgccctgggcgcgctcgcacctccccctctcctcccacggcccctccttcctgggccccagcatccgttctgaggggtgtagcagcccctgccctgggcgcgctcgcacctccccctctcctcccacggcccctctttcctgggcctcagcatccgttctgaggggtggaggtgaatccctttggtgacctcccttatgggtgcaacaggctctgctaaggctcgctgcagggacggggagcttgccacttctcaggcctccccatttcctgctgcctagctctgagtgctttgagttcttccttaggctgagcaaaatctacctgtcctttctcctttagtcccaggcctgtcttcagggcctccctgcctgctcctctgcccccattaggttacaggtggtcctgcccacggtgcaggnngaacttctagctagggtgtcttatagcagggacccagcatgccaggcaacaggcggtggagtccagcacatgngctctggaccacctgngttcagactccggcttcatcactgcttagcagccttgggcaagtncccggtgcagatgagagtagttctggcttctgttgaggattaaatgggtcatgtgaggtgctgagcgtggtgtcagtacaaaggaagtggtcagtgactattagcggtagtgacgatgatgatgacagcgccccacctccctgtggaatctgggccctgaagagccgcagccctcctagagttctgttccacccccagaggtataagccagggcccctcggagcccggccgtttttatttcttaaaccatgtatatatattttttatttttttgagacggagtctcgctctgtcgcccaggctggagtgcagtggcgcgatctcagctcactgcaacctccgctccgggttcaagtgattccctgcctcagcctgctgagtaactgggactacaggtgcatgccattatgcctggctaattgtttttttgagatggagtcttgctctgttgccaggccagagtgcagtggtgcaatcttggctcactgcaacctccgcctcctgggttcaagcgattctcctgcctcagcctcccaagtagctgggactacaggcacgtgccacaatgcctggctaatttttgtatttttagtagagacgggtttcaccatgttggccaggatggtctcaatctcttgacctcctgatccacccacctcgacctcccaaagtgctgggattacaggcgtgagccaccacgcccggcctggttctgtcttaaatcatggttgtcactgggggcctggcctcctccctgtctccagccttgtttgtgcattccgttagtgtgctggggagggttcctcactgaggttgagaggtgtgttggataggactgatcccacctgccccttgctggtcctgtacccaccctctccccagcctcacctggggtgggaggcggagggggaggttgggggtgggaggagctggggtggggctgggtcactgaggccgcccctttctcaagagcgtctttgcttcctcctccgccaccgccctgccgtgctgtgtccgcatccctccggccccgccccagcctcctgaccctgctctggacccacacactcacagtgctggtggaggcggccgctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctta

SEQ ID NO: 376431 - DNA, 4785 bp, Homo sapiens
agaggagggtcctgtagggatcccagctggggaaggtgcaggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggaggtaggagtgacctcactggggagagagctggccttggggagcactgtggtctcgggtacgggtgccctgctgtctggccccacctctcgaaggctgggactggggaccagcgaccctcccctgcctactccaccctggggagagccccctgggccagcagagcaggggctgccagatggactctgggccactgtgggcctcaggccctgtggtctgaggctctcagaacccctccctcccggttggcctgaccccatcccctactcctccagcttcagaagagccgactccattaggtgggggtgtccctgctgtggggtgagctgttcggggagcagcagacccccaggccgacgtggcacccccctcacctccgctgccgagcctcacttccgctgctgggtgaggagcaagccgccactgataagcagagctgttccctctggggaagggagggaggtggggtgcgggtgcggagggctcgcgctgctgggcacccatggacctcagccacggcgggcccagggacggacctccaggaggcctgctgggggaacagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccagggggagcaaaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctta

SEQ ID NO: 376432 - DNA, 3595 bp, Homo sapiens
aaaaaaaaaaaaaaaaaaaaagggatgcggctgggaggagggaagtttggcagggataggctacaactccatggctctgggctgtggtcacttactgcttcgtctgggggcatccaccctccagggccctcaaccacgcccttttctccatacagggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccagggggagcaaaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctta

SEQ ID NO: 376433 - DNA, 3397 bp, Homo sapiens
cacgggctgggcatccccgcctgtcaggacctgcgctgccgagaggaccagtggtaccccctggaaccccgcactgagacctacccagaccgaggccagtgccacctccagttccaactcatccataagcgggtaggtcgggtactgggccagtggccatgcccagctcttgcggcggtctgctgggttgcggggctggctgcacccagtgtgaggccctgtctgctcacagaggcctcattgcagagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccagggggagcaaaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctta

SEQ ID NO: 376434 - DNA, 3031 bp, Homo sapiens
gggtcctgtagggatcccagctggggaaggtgcaggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcgggtaggtcgggtactgggccagtggccatgcccagctcttgcggcggtctgctgggttgcggggctggctgcacccagtgtgaggccctgtctgctcacagaggcctcattgcagagagccacttcggccagccgctcgcagccgagctacaccgtgcacctccacctcctgcagcagcttgtgtcccacgaggtcacccagcacgagtgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccagggggagcaaaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctta

SEQ ID NO: 376435 - DNA, 1719 bp, Homo sapiens
cctggaaggttccagggctgtagaggaggccagtgtggctgggacaggctgagcaacggagaggggaaggcagagaggccattctgcccctgatgaagttcctggaggtggagctttgctacatgaacaccaacttggtgcaggagaacttcagcagcctcctgaccctgctctggacccacacactcacagtgctggtggaggcggccgctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccagggggagcaaaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctta

SEQ ID NO: 376436 - DNA, 1069 bp, Homo sapiens
gggtcctgtagggatcccagctggggaaggtgcaggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggtgaggaggatgaggaaaggggcccaggagcgaggcagagggagggggttgggaggggttctggggagaggctctgtgtcctcacaaagctgagcctggggtcca

SEQ ID NO: 376437 - DNA, 342 bp, Homo sapiens
ggggtggattccagcctaatcccttccgacccttgctgcgtcccccttatgggaccctgcctgacgcaggatctttaaagaggcccggaaggacaaaggccaggacgactttctggggaacgtggttctgaggctgcaggtgaggaggatgaggaaaggggcccaggagcgaggcagagggagggggttgggaggggttctggggagaggctctgtgtcctcacaaagctgagcctggggtccacctcctgtcgcctccgctgccccgactctatgaggttctgacgctcacgggctgggcatccccgcctgtcaggacctgcgctgccgagaggaccagtg

SEQ ID NO: 376438 - DNA, 640 bp, Homo sapiens
ggtgaggcttgggttctgcctggacctccaaagcgtagtaaaagccagtaacccgctctgaacatcccttttgggtgcacttgagtccagttttgtgcaaaacgctgcctctggatatccttggggctgtggcttcactttgcctgagatcctgcagcctgggggtctgggcggagccgtgcttgtctcttgtgaagctccctgcccagctctgtgcctggtgatggtagctgctctatgaatgaaggaaggagggaagggggtggatttggcagtatcctgagtcctcctttcttcccccagctggtgcccctgggtgaactgaccaagcacagcacatcagcggtggatctatccacctgctttgcccagatcagccacactgcccggcagctggactggccagacccagaggaggccttcatgattaccgtcaagtttgtggaggtgcggcatcttccacgtgtccttccccctctttctagaacagccacactaccacccaccgtttctcccgtgctctcacccaggcagcctcccaaggcctgtattctaaatcccccaagtcgctgaaattcccatgccctcccacctgcccttcctggatgccccacccatggatcagttccctctgtccaac

SEQ ID NO: 376439 - DNA, 6011 bp, Homo sapiens
  misc_feature (1293)..(1293): n is a, c, g, or t
  misc_feature (3275)..(3276): n is a, c, g, or t
  misc_feature (3349)..(3349): n is a, c, g, or t
  misc_feature (3365)..(3365): n is a, c, g, or t
  misc_feature (3410)..(3410): n is a, c, g, or t
gggtcctgtagggatcccagctggggaaggtgcaggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcgggtaggtcgggtactgggccagtggccatgcccagctcttgcggcggtctgctgggttgcggggctggctgcacccagtgtgaggccctgtctgctcacagaggcctcattgcagagagccacttcggccagccgctcgcagccgagctacaccgtgcacctccacctcctgcagcagcttgtgtcccacgaggtcacccagcacgagctcctggggctgggcgnagccggggctgcccttcaggtcctgacactcctccacctgctcccctcaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcaggtctgtagcagcccctgccctgggcgcgctcgcacctccccctctcctcccacggcccctccttcctgggccccagcatccgttctgaggggtgtagcagcccctgccctgggcgcgctcgcacctccccctctcctcccacggcccctctttcctgggcctcagcatccgttctgaggggtggaggtgaatccctttggtgacctcccttatgggtgcaacaggctctgctaaggctcgctgcagggacggggagcttgccacttctcaggcctccccatttcctgctgcctagctctgagtgctttgagttcttccttaggctgagcaaaatctacctgtcctttctcctttagtcccaggcctgtcttcagggcctccctgcctgctcctctgcccccattaggttacaggtggtcctgcccacggtgcaggnngaacttctagctagggtgtcttatagcagggacccagcatgccaggcaacaggcggtggagtccagcacatgngctctggaccacctgngttcagactccggcttcatcactgcttagcagccttgggcaagtncccggtgcagatgagagtagttctggcttctgttgaggattaaatgggtcatgtgaggtgctgagcgtggtgtcagtacaaaggaagtggtcagtgactattagcggtagtgacgatgatgatgacagcgccccacctccctgtggaatctgggccctgaagagccgcagccctcctagagttctgttccacccccagaggtataagccagggcccctcggagcccggccgtttttatttcttaaaccatgtatatatattttttatttttttgagacggagtctcgctctgtcgcccaggctggagtgcagtggcgcgatctcagctcactgcaacctccgctccgggttcaagtgattccctgcctcagcctgctgagtaactgggactacaggtgcatgccattatgcctggctaattgtttttttgagatggagtcttgctctgttgccaggccagagtgcagtggtgcaatcttggctcactgcaacctccgcctcctgggttcaagcgattctcctgcctcagcctcccaagtagctgggactacaggcacgtgccacaatgcctggctaatttttgtatttttagtagagacgggtttcaccatgttggccaggatggtctcaatctcttgacctcctgatccacccacctcgacctcccaaagtgctgggattacaggcgtgagccaccacgcccggcctggttctgtcttaaatcatggttgtcactgggggcctggcctcctccctgtctccagccttgtttgtgcattccgttagtgtgctggggagggttcctcactgaggttgagaggtgtgttggataggactgatcccacctgccccttgctggtcctgtacccaccctctccccagcctcacctggggtgggaggcggagggggaggttgggggtgggaggagctggggtggggctgggtcactgaggccgcccctttctcaagagcgtctttgcttcctcctccgccaccgccctgccgtgctgtgtccgcatccctccggccccgccccagcctcctgaccctgctctggacccacacactcacagtgctggtggaggcggccgctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccagggggagcaaaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctta

SEQ ID NO: 376440 - DNA, 4019 bp, Homo sapiens
cgcactcgaggaagtggggtgagaacccccccgggcccagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccagggggagcaaaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctta

SEQ ID NO: 376441 - DNA, 4816 bp, Homo sapiens
agaggagggtcctgtagggatcccagctggggaaggtgcaggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggaggtaggagtgacctcactggggagagagctggccttggggagcactgtggtctcgggtacgggtgccctgctgtctggccccacctctcgaaggctgggactggggaccagcgaccctcccctgcctactccaccctggggagagccccctgggccagcagagcaggggctgccagatggactctgggccactgtgggcctcaggccctgtggtctgaggctctcagaacccctccctcccggttggcctgaccccatcccctactcctccagcttcagaagagccgactccattaggtgggggtgtccctgctgtggggtgagctgttcggggagcagcagacccccaggccgacgtggcacccccctcacctccgctgccgagcctcacttccgctgctgggtgaggagcaagccgccactgataagcagagctgttccctctggggaagggagggaggtggggtgcgggtgcggagggctcgcgctgctgggcacccatggacctcagccacggcgggcccagggacggacctccaggaggcctgctgggggaacagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggccctcaaccacgcccttttctccatacagggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccagggggagcaaaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctta

SEQ ID NO: 376442 - DNA, 3636 bp, Homo sapiens
gggtcctgtagggatcccagctggggaaggtgcaggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtggggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagaggtttgcggtggggctgggtccccggtggggacttgcaagggctttcctgtagggtctggggcttccccgccacatcgcggccctccagcctggcctaacacttggggagccccagcatgcggagtgcccagagtgcagacctcccctgcctcccatggtgatgggggctcagcagcgacatctctactcccgcctccctgcctccagccctggctgcaatgtctctaccacatcccagcaccagggggagcaaaccctgcccctgcccgcctctcagaaaagctgctgtggtgggcaggggattgggccatctgtctcctggccctggcccatctgcctcctggccttcctgttccagccactggggtgggggccaggttcactgggaccagggctacaggcacagagtctcctggaaaagggagaggggaccctgccaaagatgaggctccagctgccctggggggagggtggtggccattactagagggggcctgggtcctctccccaggggctgccagcatccaggccaggaagcctggagccaagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctta

SEQ ID NO: 376443 - DNA, 3598 bp, Homo sapiens
  misc_feature (3532)..(3532): n is a, c, g, or t
  misc_feature (3535)..(3535): n is a, c, g, or t
  misc_feature (3563)..(3563): n is a, c, g, or t
gggtcctgtagggatcccagctggggaaggtgcaggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcggagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattgtgagtgggtcccgttcttctcccagtccctcccctcatctctccccactgggctccctcaggcctgctcctcctggctggggccaaggggctcccctgagatggccacatttgggcccaagggatggggcatctgggacaagagtttgcagctggatgtggtggctcacacctgtcatcacagcactttgggaggccgaggcaggcggatcacttgaggtcaggagttcaagaccagcctggccaacagtctctactaaaaatacaaaattagccgggcatgatggtgggtacctgtactctcagctactcgggaggctgaggcaggagaattgcttaacccaggaggcagaggctgctgaatgaanttnggtgacaacataaaacacccgtgggcangcccacttgggctgattcagagttgaagtctccct

SEQ ID NO: 376444 - DNA, 1151 bp, Homo sapiens
gggtcctgtagggatcccagctggggaaggtgcaggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctgtacgtggccgtgctccagcccccactctatccaggtctttcctgggtagcagggtctgccccagacaatgagatgagtaggtcgtcctggctcaggggagggggtttggccctgggcaaagactagaggagaagcccatctccaggcacgttaggtggacagtaggtcagatgggacagaacaagatcaatgccacacgtgctgatggggcaaggagggtcaggcccttgtgggtgagtctgggggtgcctgaagctgtacctgaaaggaggcagggatgggtgcagtggttcccacctgtaatcccagcactttgggaggccaggagactgagaccagcctggccaacatggcaaaaccccatctctac

SEQ ID NO: 376445 - DNA, 1023 bp, Homo sapiens
gggtcctgtagggatcccagctggggaaggtgcaggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagggctggcacagacagacggaagcagaaaggacagtttggctgctgtgtctgctgcgcacgccccctccccggacagcacctgccacctagaaactttcttagcaaaaaaattaataaaaacaaatccattgtcctcttaaaatatgcctttggcctacagtggggcctggaatgcgagccaggccgggtagcttcctccccagccctcaggggactttgagctaccgccaccttggggtagctacaaagcaggggggtaggtgtggaaataactgaggcagaggcagggctagggtgatttttggccgtgggctttgaataaattgctttaccaggcaaac

SEQ ID NO: 376446 - DNA, 1217 bp, Homo sapiens
agaggagggtcctgtagggatcccagctggggaaggtgcaggggcctgggagactgcctctccgaagcggtgaaaccctcacccttccgtccctcccagccaccctccctaaaacttcccctgacagagggtggcagccccaggctctttgcataatcctgtggcttcgctgtcttcacccagcaccagcggacagggaagggcagagaaggccaccatggcgacactcctctcccatccgcagcagcgccctcccttcttgcgccaggccatcaagataaggcgccgcagagtcagagatctacaggatcccccgccccaaatggccccggaggtaggagtgacctcactggggagagagctggccttggggagcactgtggtctcgggtacgggtgccctgctgtctggccccacctctcgaaggctgggactggggaccagcgaccctcccctgcctactccaccctggggagagccccctgggccagcagagcaggggctgccagatggactctgggccactgtgggcctcaggccctgtggtctgaggctctcagaacccctccctcccggttggcctgaccccatcccctactcctccagcttcagaagagccgactccattaggtgggggtgtccctgctgtggggtgagctgttcggggagcagcagacccccaggccgacgtggcacccccctcacctccgctgccgagcctcacttccgctgctgggtgaggagcaagccgccactgataagcagagctgttccctctggggaagggagggaggtggggtgcgggtgcggagggctcgcgctgctgggcacccatggacctcagccacggcgggcccagggacggacctccaggaggcctgctgggggaacagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggagaaccttctggctctgagggagcaagagctggcaggcggcagggctggcacagacagacggaagcagaaaggacagtttggctgctgtgtctgctgcgcacgccccctccccggacagcacctgccacctagaaactttcttagcaaaaaaattaataaaaacaaatccattgtcctctta

SEQ ID NO: 376447 - DNA, 2013 bp, Homo sapiens
tatttattgagcttctgtcatatgcccagtattatgcttcttctatactgtttctctgtgacaagtcatactatattctttatagaattaaaagtagaggagaggcagagtttacatattgtccagttgctttacagttgtacaggaggttataagaagaaatatagtaaattagtgggaagtcagaggtgggggcgttagtgagctattttcttcttgaggttgtgacacaagctgacaaaagccagggagttcacagctgtgtggtggcacaaagttccatatgttctaaaaacaattaggcccagcagggtgtccctaatggcttccttgttaaacctccatggccagctgatctgaagctctgtgacatgttctctgagctctgaatgctctggctttttgtcattttgtcttgagacaagtattttcctgtagtcctcattccttcgagttattccatctcccaggatattctctggtgagaagaatgtctttcagtgaatttgccttgaatttagcatccatagagctgtgtcagtgttcttcttgatcacaccttctttaaaaaaaatacttgcttgcgatgactggacaagttcagttggttagtttcaggcctataagaagagagagtaaaggaccttgctatttactttgataccatagttgtatctcaggatggcctgcaaaccactggccttgtgtgtatttaagctaggaataaaataatggagaagtgttaatatgtatacaaaaaggtaaatattgatatatctactctctgttgggggcagaagtgtcattttaagttattcaaagcactttcttaagcattttagaaagcctttattctttgctgttggaagtctccgtactttgcagaattggtatttgtgtactagcctctgccgcaggatggggaggtgggcaggtagctgataggggcagccaggagtttttgaggcaggtggtgggaaattgtcctaatttgttaattggattatgtaactctgttactagtctgttattggctgttgttactggatgcatcttgatattcagaagaataactgtgaggcattcttcagttgcgggttaagtggggttagtttctgttctgtcagatgccctttttcagtcaaaggttagccccttgtttctccctccttccagggtttagggagtgcagtgatgtcgatttcatttcccttccccgcaccccttgacactcagcaggattgcactgaaacccttcacagatctctcgttcactagttgtctcctatttttccataactagcactagtttggccttatgacctggttagaatcactcttctgtattctcatttccaatttttgtgccccactaacgtggactagagaaacttggcctgctgtgcagtgggccttctgttcaacttaccctccaccgctgaccctgtgtgaagagagatggtgcgttactgccatctaatgggaaaagagaaaactgcagttgggaaaagcagctgtgcatttaagggtagggctttctgaaggatttctgatacagtccagaaaagggaaaatgatgacacagcagttgccatcttgaaaaatgccctttcctgcggaaagggtgttttgaagtctaatacaactatcatcacaaggtccctggactaaggctggatcgtgtaatttagaatctcaaattgtattttaattaatatgctggcaacagaatcattgaaacaggcatctcattttgtcaagttcttagccgttcagtttgtcaggggctttaatattttagatatcaactaatacatagtttcaacttttaaaaatgtttgaagattgtatgtaatataggtgcctatctatagtgccttagtaatttaaatcagaaatattttataaaacttctggttgttttgcagtagccaatataggcttcatgccctcctgaagatagtttcctctgaaatgtaactttaaataaacattattccaagaaaactacag

SEQ ID NO: 376448 - DNA, 893 bp, Homo sapiens
ggcggcccgaagagatgcgttcggcaagttagccccttgtttctccctccttccagggtttagggagtgcagtgatgtcgatttcatttcccttccccgcaccccttgacactcagcaggattgcactgaaacccttcacagatctctcgttcactagttgtctcctatttttccataactagcactagtttggccttatgacctggttagaatcactcttctgtattctcatttccaatttttgtgccccactaacgtggactagagaaacttggcctgctgtgcagtgggccttctgttcaacttaccctccaccgctgaccctgtgtgaagagagatggtgcgttactgccatctaatgggaaaagagaaaactgcagttgggaaaagcagctgtgcatttaagggtagggctttctgaaggatttctgatacagtccagaaaagggaaaatgatgacacagcagttgccatcttgaaaaatgccctttcctgcggaaagggtgttttgaagtctaatacaactatcatcacaaggtccctggactaaggctggatcgtgtaatttagaatctcaaattgtattttaattaatatgctggcaacagaatcattgaaacaggcatctcattttgtcaagttcttagccgttcagtttgtcaggggctttaatattttagatatcaactaatacatagtttcaacttttaaaaatgtttgaagattgtatgtaatataggtgcctatctatagtgccttagtaatttaaatcagaaatattttataaaacttctggttgttttgcagtagccaatataggcttcatgccctcctgaagatagtttcctctgaaatgtaactttaaataaacattattccaagaaaactacag

SEQ ID NO: 376449 - DNA, 1204 bp, Homo sapiens
tatttattgagcttctgtcatatgcccagtattatgcttcttctatactgtttctctgtgacaagtcatactatattctttatagaattaaaagtagaggagaggcagagtttacatattgtccagttgctttacagttgtacaggaggttataagaagaaatatagtaaattagtgggaagtcagaggtgggggcgttagtgagctattttcttcttgaggttgtgacacaagctgacaaaagccagggagttcacagctgtgtggtggcacaaagttccatatgttctaaaaacaattaggcccagcagggtgtccctaatggcttccttgttaaacctccatggccagctgatctgaagctctgtgacatgttctctgagctctgaatgctctggctttttgtcattttgtcttgagacaagtattttcctgtagtcctcattccttcgagttattccatctcccaggatattctctggtgagaagaatgtctttcagtgaatttgccttgaatttagcatccatagagctgtgtcagtgttcttcttgatcacaccttctttaaaaaaaatacttgcttgcgatgactggacaagttcagttggttagtttcaggccctccaccgctgaccctgtgtgaagagagatggtgcgttactgccatctaatgggaaaagagaaaactgcagttgggaaaagcagctgtgcatttaagggtagggctttctgaaggatttctgatacagtccagaaaagggaaaatgatgacacagcagttgccatcttgaaaaatgccctttcctgcggaaagggtgttttgaagtctaatacaactatcatcacaaggtccctggactaaggctggatcgtgtaatttagaatctcaaattgtattttaattaatatgctggcaacagaatcattgaaacaggcatctcattttgtcaagttcttagccgttcagtttgtcaggggctttaatattttagatatcaactaatacatagtttcaacttttaaaaatgtttgaagattgtatgtaatataggtgcctatctatagtgccttagtaatttaaatcagaaatattttataaaacttctggttgttttgcagtagccaatataggcttcatgccctcctgaagatagtttcctctgaaatgtaactttaaataaacattattccaagaaaactacag

SEQ ID NO: 376450 - DNA, 588 bp, Homo sapiens
gatttttttttgtgtgtgagataattaggaaagaagatttattgtttacccttgcagtgtttatggggggaaaaggtatttacagaattactgttgctagcgagaatatacagtaaagtttaaaacattttggagaattgattttgattcttaaaatgtgtctttttgcaacatatgctctggttacctataaatacattaatttggcccttgaaaacattcacatcctattctttgttagccttatttttccagtccttgttaactctctcagtgctggataataaacctgcatttcttttaaaacatttgttcagtttcggcatcagtgtcttcccccagcactcccttaatctaaattagtaacattttactgtatgaaaaatagttgctgttaactaaaaattcaataggtgagttagacatggcttttcaagtaggattttcagtggcttcagattccatcatacacaagtgtatgttttttctgtgtaagttttttccgtgtaagttttttgacatagcagactaaagtggggagaagatggttgagcacttacggttgagcacggaaaaaacttacacgga

SEQ ID NO: 376451 - DNA, 525 bp, Homo sapiens
gatttttttttgtgtgtgagataattaggaaagaagatttattgtttacccttgcagtgtttatggggggaaaaggtatttacagaattactgttgctagcgagaatatacagtaaagtttaaaacattttggagaattgattttgattcttaaaatgtgtctttttgcaacatatgctctggttacctataaatacattaatttggcccttgaaaacattcacatcctattctttgttagccttatttttccagtccttgttaactctctcagtgctggataataaacctgcatttcttttaaaacatttgttcagtttcggcatcagtgtcttcccccagcactcccttaatctaaattagtaacattttactgtatgaaaaatagttgctgttaattcggcacgaggcgcaatgcttttttttttttttttttttacaaactgaaattcaatccatttatttacacgtacattgtacataagtttacaaattctcacttctgccactcagctagaacttttc

SEQ ID NO: 376452 - DNA, 549 bp, Homo sapiens
  misc_feature (168)..(168): n is a, c, g, or t
cattggtccgagagaaattaggaaattgggagggtggaagaggataagagggtgtgtgatacttgagtttgagctctcataggtagacagttggagttgatgaaaaggtcaaaggtaaggccatgggaattagttctcagtggagcttatgtgaatgctaatttctcncggagccggtccattggtccgagagaaattagaaatgcctgtatagatgtcctcaaggaacttgtacttttgagtccccatgattttcttcatactctggttccctttctacaacacaaccattgtacttaccatcacagtaatataccataatttctctcggaccaatgcattggtccgagagaaattagttgtcagctcagcaaagatacaacctggataaagaacttcaggagcttgggagatgacagatcagatgccacagaaaaggggtgccaccctgtaaataggtttgatttctgtaaaagtgttctctgagcctaaatgggaaagaagccttcctactgtgaggtaatactatgtgaatttttggaaaccatg

SEQ ID NO: 376453 - DNA, 1109 bp, Homo sapiens
aaaatatagaaaatatgcagttatgactagaaatagctgtaatattgtacctgcagagttgagtatctcactagtataatttataattataacctattctgatttcttttcaaatattaggtgtcctagttgcctatgaaggtttgccacttcatcttgcactgttccccaaactttggactgagctatgccagactcaggtaaagaaaatgagttttagatgattggtctttaatcttatctgaccaagtggtcaataattttaggaacagtgggttgaagacttgctgaaaagtggggacattttagaatcttgataggtaacatatgaatgaatgaaaatactagctattacatattaggcatctagtttccctttgatttttttaacttaagtagatttctatcatagaggatattttaaataagctggttataattgaatttctcatttatagatgtatatcaacagttgtggggaaaatccaaaacagggagatagtgggggaaaaggcacttgccacttcttcctctccttcacctccctgtctctacctcttttccaccattccaaaacctctagcagaaaccctgtcagcagtctgtcctttagcttttcataatctgtagtttttcaggggtctgatgcacttgttttcttacagcgatctccttgaaaacaggaaagattactgttcctaccttaagtgtctaagagccaactccttaaaattaagtggctgcataaataatgcttgttaagttacaaaggcagaattgggaagaggaggaggtactaatgtttggctcattccttggatcaggcataaaggatccccactacctttcagtccctgaaaaaactgttgattgtactgcctggttgcatctgctctaccccattggaagagatgaatttattcaccttccttaggtgcaacccttgacccacatcatgctttcctgaagtattttgagtctggttcagcctcctaccaggctgtagtgtgctctggattctcctagatgtttgccatcctgtactctactggtggtttctctacttttccaaaacagaactcaagtgtagagaccttatcagagtcatc

SEQ ID NO: 376454 - DNA, 616 bp, Homo sapiens
tttggttaaattcctgtcttctgcaatttgaccaagactcctgtcttccctggtccccactgtgggaccaaaaccatgttttattgcttctttgtttcctttatgtttctgtagcagacaattcttttaagattttctgaagagtgttgttttttgcagtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacggtaagttttattcagaaattataa

SEQ ID NO: 376455 - DNA, 8182 bp, Homo sapiens
  misc_feature (1184)..(1184): n is a, c, g, or t
  misc_feature (2847)..(2847): n is a, c, g, or t
  misc_feature (2902)..(2902): n is a, c, g, or t
  misc_feature (4118)..(4118): n is a, c, g, or t
  misc_feature (4546)..(4546): n is a, c, g, or t
  misc_feature (4620)..(4620): n is a, c, g, or t
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttgggtaagtttggtaaatttcatagtagatattttacacattttaaaaaaatcttacgtgtgaattttaaatgattatttttaaattctagatttatgtggcaattgtgtagttgtattcccagtacattaccagatcctaaagctgtgtccttaatgacagcaaaggtaataaatatatgaacttnaaataattctgtcaaaatttactactttaaaatgattgaagcttttttgctttatcttttcttacagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttgcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagaggtaaatattctattgcattttactgtggatattatctcattttaatgttctcaccaagacttactttatagacatttagagtttatggtaaactgttttacaggtggcaaggttttaattatatagatcagtaaacctgaatttatatcccaagaataattaggtcataatttttagggtgctgttcctttttccatagtaattccatacttttcccattattttgtatntagaacagccatttgaaatagactagttttattcatttgtagggacaaaaatganatacatgtgatttcattaagggcacacataatttcccaaaagcctacttatttgacagtatagaaactgaggttaccattgtgaacccggaaaatctgagacaggtctcagttaatttagaaagtttattttgccaaggttgaggacgcgcccgtgacacagcctcaggaagtcctgatggcacgtgcccaaggtggttgggacacagcttgattttatacattttagggagacatgagacatcaatctgtatgtaggaagtacattagctctgtccagaaaggcagagacaacccaaagcaaggcctctccttcctctggggccttcctggtcacaggtatgtgagagacagatggttgcgttcttttgagtttctgataagtctttccaaaggaggcaatcagaatatgcatctatctgggtgagcagagggatgactttgaatagtatgagaggccgatttgccctgagcggttcccagcttgaaggggcccaagatattttcctttcacaccatcctcagaggaaaccagaaggactattacagggttaaaatcagctgtttatgcttcctataattcttgaacatccacaagtatgagatggctgcagagtcaccagaggtacgtgagccctttagtctgataaacatgccaagagtaccataagaattcacaggtaggatgttttttcagttaatgataataaaaaataagagaacaggtttgcactttgaagaatgtggatttgcaaaggtaagggggaaaacatttagataaatgacaataagcactgaggcaaagaaatattggttatgtttgaggaaggctaagtattaaaaaaaaggtaggtgaagaggagtagtaagaatttcattctttaaaatgcaacagatgtttatgctgctttggttgtatttttagaaaaaaaaaatttttttttaatgcaacagatgtttaaatgtctacctctgtgccaagcactgtggtaggtactagggacacagcagtgaacaagacatactggtttctgtccccacagcttacaagttacatactgtacaagtacattgttcatattaggtactgctgcaggttctgggctaagaattttaacatttgaactgtgggtattacagtgtgtaagctgtagtgaactggtggaagaggattcaaagaagggtgctgtatagtaaaataggaaaaaaactaaggncttaattaagctaatacagttaaaggaattaaaagatttaacaagccaatataaaggaaatgaattcctaccttttgcagctctttttacctctttcaggcctactcttttgagtatggctgacagtcactttaccattgtctttggacagagaccctggaaagttggttaaagcagttgcctattctccctaatcttttgtgacctactgctttgtaattttgaagacttaacaatcttagagcaagtacttttttaaaaaaatgtgattaaactatttcttcagactagaatatacacacaaaatagcagagctctgaaggtgaggaatgtttaaaagagcttaatgagagtttaacttcaggatagaaagcaaatacgtttgctttgcacacatgtgcacacacagtctgagtctgaaaacatcnatcgtagaggacgagtactaccattttgtggctcagtaagcaaaaatgaaattaagttttcaattttttcaaancatttgtagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccatttctctcggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggtaagaactatgcagaggcggcggcacacacttttaaactgtccttcagttaactgtgtggccttcatatgattttactctcgtaactttaacttactgattcaaactcttaagccatgtgcgacaaaaaaacaagttttaaatacacgtttactatgccttgtatgtacacagcacactctatcaccttggaagctacaagctggtatcattaaatgctgaaaggtaataaagggaacatcttagtggtcttatctctacttgggtatatttttggaaacaatacttgtgatgtttctattactgcctatggctcctatgtaactgaaacaattaatgatctactgatttaaaaaaggcagttaaatctagagcattagttgccttgtgcagactcccatgacagccatgtcctagaataatggaacactctggaaatgggctagaatgttgagcagcagcctcccaaatcacagtatgcataaaagccaaaacagatgacagagctcagtaaggaagaccttactatttgtgacatccatcagaattttaacttgagaaactgatttcaaggtttgtttttaaaattcttatatttccttttccatttttcagaaaacactatttcaggctttggtctgacttactggttcgtgggcataaaataatgctattagtgactttaagaactaatgaggctgggcacggtggctcatgcctgcaatccaagcattttgggaggtcgaggccggtggataacgaggtcaggagattgagaccatcctggccaacatggtgaaaccctgtctctactaaaatagaaaaaattaagccaggcgtggtggcgggcgcctgtagtcccagctacttgggaggctgagggaggggaatcgcttgaacccgggtggtggaggttgcagcgagccgagattacaccactgcactccagccttgccaaagaacaagactccatctcaaaaaaaacaaaaacaaaacaaaaaaaaaaacaactaatgaaatgctgtagtatcttaacactggctttctggttttatcattctaagaatcccagagaaaccagggtattcttaggaaagaatggattcctgggaaaataaacatctgcaattaactgtaaacaactgcatcaaagtgttggctttagaatttgaaatgttcctatctgggtttttgtaggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttca

SEQ ID NO: 376456 - DNA, 8382 bp, Homo sapiens
  misc_feature (1184)..(1184): n is a, c, g, or t
  misc_feature (2847)..(2847): n is a, c, g, or t
  misc_feature (2902)..(2902): n is a, c, g, or t
  misc_feature (4118)..(4118): n is a, c, g, or t
  misc_feature (4546)..(4546): n is a, c, g, or t
  misc_feature (4620)..(4620): n is a, c, g, or t
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttgggtaagtttggtaaatttcatagtagatattttacacattttaaaaaaatcttacgtgtgaattttaaatgattatttttaaattctagatttatgtggcaattgtgtagttgtattcccagtacattaccagatcctaaagctgtgtccttaatgacagcaaaggtaataaatatatgaacttnaaataattctgtcaaaatttactactttaaaatgattgaagcttttttgctttatcttttcttacagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttgcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagaggtaaatattctattgcattttactgtggatattatctcattttaatgttctcaccaagacttactttatagacatttagagtttatggtaaactgttttacaggtggcaaggttttaattatatagatcagtaaacctgaatttatatcccaagaataattaggtcataatttttagggtgctgttcctttttccatagtaattccatacttttcccattattttgtatntagaacagccatttgaaatagactagttttattcatttgtagggacaaaaatganatacatgtgatttcattaagggcacacataatttcccaaaagcctacttatttgacagtatagaaactgaggttaccattgtgaacccggaaaatctgagacaggtctcagttaatttagaaagtttattttgccaaggttgaggacgcgcccgtgacacagcctcaggaagtcctgatggcacgtgcccaaggtggttgggacacagcttgattttatacattttagggagacatgagacatcaatctgtatgtaggaagtacattagctctgtccagaaaggcagagacaacccaaagcaaggcctctccttcctctggggccttcctggtcacaggtatgtgagagacagatggttgcgttcttttgagtttctgataagtctttccaaaggaggcaatcagaatatgcatctatctgggtgagcagagggatgactttgaatagtatgagaggccgatttgccctgagcggttcccagcttgaaggggcccaagatattttcctttcacaccatcctcagaggaaaccagaaggactattacagggttaaaatcagctgtttatgcttcctataattcttgaacatccacaagtatgagatggctgcagagtcaccagaggtacgtgagccctttagtctgataaacatgccaagagtaccataagaattcacaggtaggatgttttttcagttaatgataataaaaaataagagaacaggtttgcactttgaagaatgtggatttgcaaaggtaagggggaaaacatttagataaatgacaataagcactgaggcaaagaaatattggttatgtttgaggaaggctaagtattaaaaaaaaggtaggtgaagaggagtagtaagaatttcattctttaaaatgcaacagatgtttatgctgctttggttgtatttttagaaaaaaaaaatttttttttaatgcaacagatgtttaaatgtctacctctgtgccaagcactgtggtaggtactagggacacagcagtgaacaagacatactggtttctgtccccacagcttacaagttacatactgtacaagtacattgttcatattaggtactgctgcaggttctgggctaagaattttaacatttgaactgtgggtattacagtgtgtaagctgtagtgaactggtggaagaggattcaaagaagggtgctgtatagtaaaataggaaaaaaactaaggncttaattaagctaatacagttaaaggaattaaaagatttaacaagccaatataaaggaaatgaattcctaccttttgcagctctttttacctctttcaggcctactcttttgagtatggctgacagtcactttaccattgtctttggacagagaccctggaaagttggttaaagcagttgcctattctccctaatcttttgtgacctactgctttgtaattttgaagacttaacaatcttagagcaagtacttttttaaaaaaatgtgattaaactatttcttcagactagaatatacacacaaaatagcagagctctgaaggtgaggaatgtttaaaagagcttaatgagagtttaacttcaggatagaaagcaaatacgtttgctttgcacacatgtgcacacacagtctgagtctgaaaacatcnatcgtagaggacgagtactaccattttgtggctcagtaagcaaaaatgaaattaagttttcaattttttcaaancatttgtagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccatttctctcggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggtaagaactatgcagaggcggcggcacacacttttaaactgtccttcagttaactgtgtggccttcatatgattttactctcgtaactttaacttactgattcaaactcttaagccatgtgcgacaaaaaaacaagttttaaatacacgtttactatgccttgtatgtacacagcacactctatcaccttggaagctacaagctggtatcattaaatgctgaaaggtaataaagggaacatcttagtggtcttatctctacttgggtatatttttggaaacaatacttgtgatgtttctattactgcctatggctcctatgtaactgaaacaattaatgatctactgatttaaaaaaggcagttaaatctagagcattagttgccttgtgcagactcccatgacagccatgtcctagaataatggaacactctggaaatgggctagaatgttgagcagcagcctcccaaatcacagtatgcataaaagccaaaacagatgacagagctcagtaaggaagaccttactatttgtgacatccatcagaattttaacttgagaaactgatttcaaggtttgtttttaaaattcttatatttccttttccatttttcagaaaacactatttcaggctttggtctgacttactggttcgtgggcataaaataatgctattagtgactttaagaactaatgaggctgggcacggtggctcatgcctgcaatccaagcattttgggaggtcgaggccggtggataacgaggtcaggagattgagaccatcctggccaacatggtgaaaccctgtctctactaaaatagaaaaaattaagccaggcgtggtggcgggcgcctgtagtcccagctacttgggaggctgagggaggggaatcgcttgaacccgggtggtggaggttgcagcgagccgagattacaccactgcactccagccttgccaaagaacaagactccatctcaaaaaaaacaaaaacaaaacaaaaaaaaaaacaactaatgaaatgctgtagtatcttaacactggctttctggttttatcattctaagaatcccagagaaaccagggtattcttaggaaagaatggattcctgggaaaataaacatctgcaattaactgtaaacaactgcatcaaagtgttggctttagaatttgaaatgttcctatctgggtttttgtaggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaaggttagctttatggactactatcattacctttagggtgggaggagggagtaatacacttggtgtaactggtttaagagttgtgtgttcagctgaacctcctaaatataaatgctagaaacaaaattaacttcccacatccccccctaacgtgatcttaatgactttcagagaagtttcccttttggcatgtgttttcacagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttca

SEQ ID NO: 376457 - DNA, 8638 bp, Homo sapiens
  misc_feature (1184)..(1184): n is a, c, g, or t
  misc_feature (2847)..(2847): n is a, c, g, or t
  misc_feature (2902)..(2902): n is a, c, g, or t
  misc_feature (4118)..(4118): n is a, c, g, or t
  misc_feature (4546)..(4546): n is a, c, g, or t
  misc_feature (4620)..(4620): n is a, c, g, or t
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttgggtaagtttggtaaatttcatagtagatattttacacattttaaaaaaatcttacgtgtgaattttaaatgattatttttaaattctagatttatgtggcaattgtgtagttgtattcccagtacattaccagatcctaaagctgtgtccttaatgacagcaaaggtaataaatatatgaacttnaaataattctgtcaaaatttactactttaaaatgattgaagcttttttgctttatcttttcttacagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttgcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagaggtaaatattctattgcattttactgtggatattatctcattttaatgttctcaccaagacttactttatagacatttagagtttatggtaaactgttttacaggtggcaaggttttaattatatagatcagtaaacctgaatttatatcccaagaataattaggtcataatttttagggtgctgttcctttttccatagtaattccatacttttcccattattttgtatntagaacagccatttgaaatagactagttttattcatttgtagggacaaaaatganatacatgtgatttcattaagggcacacataatttcccaaaagcctacttatttgacagtatagaaactgaggttaccattgtgaacccggaaaatctgagacaggtctcagttaatttagaaagtttattttgccaaggttgaggacgcgcccgtgacacagcctcaggaagtcctgatggcacgtgcccaaggtggttgggacacagcttgattttatacattttagggagacatgagacatcaatctgtatgtaggaagtacattagctctgtccagaaaggcagagacaacccaaagcaaggcctctccttcctctggggccttcctggtcacaggtatgtgagagacagatggttgcgttcttttgagtttctgataagtctttccaaaggaggcaatcagaatatgcatctatctgggtgagcagagggatgactttgaatagtatgagaggccgatttgccctgagcggttcccagcttgaaggggcccaagatattttcctttcacaccatcctcagaggaaaccagaaggactattacagggttaaaatcagctgtttatgcttcctataattcttgaacatccacaagtatgagatggctgcagagtcaccagaggtacgtgagccctttagtctgataaacatgccaagagtaccataagaattcacaggtaggatgttttttcagttaatgataataaaaaataagagaacaggtttgcactttgaagaatgtggatttgcaaaggtaagggggaaaacatttagataaatgacaataagcactgaggcaaagaaatattggttatgtttgaggaaggctaagtattaaaaaaaaggtaggtgaagaggagtagtaagaatttcattctttaaaatgcaacagatgtttatgctgctttggttgtatttttagaaaaaaaaaatttttttttaatgcaacagatgtttaaatgtctacctctgtgccaagcactgtggtaggtactagggacacagcagtgaacaagacatactggtttctgtccccacagcttacaagttacatactgtacaagtacattgttcatattaggtactgctgcaggttctgggctaagaattttaacatttgaactgtgggtattacagtgtgtaagctgtagtgaactggtggaagaggattcaaagaagggtgctgtatagtaaaataggaaaaaaactaaggncttaattaagctaatacagttaaaggaattaaaagatttaacaagccaatataaaggaaatgaattcctaccttttgcagctctttttacctctttcaggcctactcttttgagtatggctgacagtcactttaccattgtctttggacagagaccctggaaagttggttaaagcagttgcctattctccctaatcttttgtgacctactgctttgtaattttgaagacttaacaatcttagagcaagtacttttttaaaaaaatgtgattaaactatttcttcagactagaatatacacacaaaatagcagagctctgaaggtgaggaatgtttaaaagagcttaatgagagtttaacttcaggatagaaagcaaatacgtttgctttgcacacatgtgcacacacagtctgagtctgaaaacatcnatcgtagaggacgagtactaccattttgtggctcagtaagcaaaaatgaaattaagttttcaattttttcaaancatttgtagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccatttctctcggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggtaagaactatgcagaggcggcggcacacacttttaaactgtccttcagttaactgtgtggccttcatatgattttactctcgtaactttaacttactgattcaaactcttaagccatgtgcgacaaaaaaacaagttttaaatacacgtttactatgccttgtatgtacacagcacactctatcaccttggaagctacaagctggtatcattaaatgctgaaaggtaataaagggaacatcttagtggtcttatctctacttgggtatatttttggaaacaatacttgtgatgtttctattactgcctatggctcctatgtaactgaaacaattaatgatctactgatttaaaaaaggcagttaaatctagagcattagttgccttgtgcagactcccatgacagccatgtcctagaataatggaacactctggaaatgggctagaatgttgagcagcagcctcccaaatcacagtatgcataaaagccaaaacagatgacagagctcagtaaggaagaccttactatttgtgacatccatcagaattttaacttgagaaactgatttcaaggtttgtttttaaaattcttatatttccttttccatttttcagaaaacactatttcaggctttggtctgacttactggttcgtgggcataaaataatgctattagtgactttaagaactaatgaggctgggcacggtggctcatgcctgcaatccaagcattttgggaggtcgaggccggtggataacgaggtcaggagattgagaccatcctggccaacatggtgaaaccctgtctctactaaaatagaaaaaattaagccaggcgtggtggcgggcgcctgtagtcccagctacttgggaggctgagggaggggaatcgcttgaacccgggtggtggaggttgcagcgagccgagattacaccactgcactccagccttgccaaagaacaagactccatctcaaaaaaaacaaaaacaaaacaaaaaaaaaaacaactaatgaaatgctgtagtatcttaacactggctttctggttttatcattctaagaatcccagagaaaccagggtattcttaggaaagaatggattcctgggaaaataaacatctgcaattaactgtaaacaactgcatcaaagtgttggctttagaatttgaaatgttcctatctgggtttttgtaggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttcatttgtttacatacgttgcttcagtcttctcaggtgaaagtagtgagaaaaccgtgaaagaggggggaaacatttatccattatatgctgtttcactggaagtgttaccagcagtccacagaactaatgtgtccccacagacttctcaatcctctccacaccgaagtgcaaaaccacagcagggagatgtgcagggagatgtggagcaaaacacagccaatttgccctcacctcaacatgcttttgaatgcaatataccactgttttacgacctaagatctacacaccttaaaaaccctaaagtaaaataaaggaatagtgtcaacatgccatttattttttgtcatcttgaactaaaagtacagctgcaagcaagcttgctataggacaagcttcagcttgggaaacatcaactatctgcactcaggacttacctatttccagaggaatatcgatg

SEQ ID NO: 376458 - DNA, 8099 bp, Homo sapiens
  misc_feature (1184)..(1184): n is a, c, g, or t
  misc_feature (2847)..(2847): n is a, c, g, or t
  misc_feature (2902)..(2902): n is a, c, g, or t
  misc_feature (4118)..(4118): n is a, c, g, or t
  misc_feature (4546)..(4546): n is a, c, g, or t
  misc_feature (4620)..(4620): n is a, c, g, or t
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttgggtaagtttggtaaatttcatagtagatattttacacattttaaaaaaatcttacgtgtgaattttaaatgattatttttaaattctagatttatgtggcaattgtgtagttgtattcccagtacattaccagatcctaaagctgtgtccttaatgacagcaaaggtaataaatatatgaacttnaaataattctgtcaaaatttactactttaaaatgattgaagcttttttgctttatcttttcttacagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttgcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagaggtaaatattctattgcattttactgtggatattatctcattttaatgttctcaccaagacttactttatagacatttagagtttatggtaaactgttttacaggtggcaaggttttaattatatagatcagtaaacctgaatttatatcccaagaataattaggtcataatttttagggtgctgttcctttttccatagtaattccatacttttcccattattttgtatntagaacagccatttgaaatagactagttttattcatttgtagggacaaaaatganatacatgtgatttcattaagggcacacataatttcccaaaagcctacttatttgacagtatagaaactgaggttaccattgtgaacccggaaaatctgagacaggtctcagttaatttagaaagtttattttgccaaggttgaggacgcgcccgtgacacagcctcaggaagtcctgatggcacgtgcccaaggtggttgggacacagcttgattttatacattttagggagacatgagacatcaatctgtatgtaggaagtacattagctctgtccagaaaggcagagacaacccaaagcaaggcctctccttcctctggggccttcctggtcacaggtatgtgagagacagatggttgcgttcttttgagtttctgataagtctttccaaaggaggcaatcagaatatgcatctatctgggtgagcagagggatgactttgaatagtatgagaggccgatttgccctgagcggttcccagcttgaaggggcccaagatattttcctttcacaccatcctcagaggaaaccagaaggactattacagggttaaaatcagctgtttatgcttcctataattcttgaacatccacaagtatgagatggctgcagagtcaccagaggtacgtgagccctttagtctgataaacatgccaagagtaccataagaattcacaggtaggatgttttttcagttaatgataataaaaaataagagaacaggtttgcactttgaagaatgtggatttgcaaaggtaagggggaaaacatttagataaatgacaataagcactgaggcaaagaaatattggttatgtttgaggaaggctaagtattaaaaaaaaggtaggtgaagaggagtagtaagaatttcattctttaaaatgcaacagatgtttatgctgctttggttgtatttttagaaaaaaaaaatttttttttaatgcaacagatgtttaaatgtctacctctgtgccaagcactgtggtaggtactagggacacagcagtgaacaagacatactggtttctgtccccacagcttacaagttacatactgtacaagtacattgttcatattaggtactgctgcaggttctgggctaagaattttaacatttgaactgtgggtattacagtgtgtaagctgtagtgaactggtggaagaggattcaaagaagggtgctgtatagtaaaataggaaaaaaactaaggncttaattaagctaatacagttaaaggaattaaaagatttaacaagccaatataaaggaaatgaattcctaccttttgcagctctttttacctctttcaggcctactcttttgagtatggctgacagtcactttaccattgtctttggacagagaccctggaaagttggttaaagcagttgcctattctccctaatcttttgtgacctactgctttgtaattttgaagacttaacaatcttagagcaagtacttttttaaaaaaatgtgattaaactatttcttcagactagaatatacacacaaaatagcagagctctgaaggtgaggaatgtttaaaagagcttaatgagagtttaacttcaggatagaaagcaaatacgtttgctttgcacacatgtgcacacacagtctgagtctgaaaacatcnatcgtagaggacgagtactaccattttgtggctcagtaagcaaaaatgaaattaagttttcaattttttcaaancatttgtagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccatttctctcggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggtaagaactatgcagaggcggcggcacacacttttaaactgtccttcagttaactgtgtggccttcatatgattttactctcgtaactttaacttactgattcaaactcttaagccatgtgcgacaaaaaaacaagttttaaatacacgtttactatgccttgtatgtacacagcacactctatcaccttggaagctacaagctggtatcattaaatgctgaaaggtaataaagggaacatcttagtggtcttatctctacttgggtatatttttggaaacaatacttgtgatgtttctattactgcctatggctcctatgtaactgaaacaattaatgatctactgatttaaaaaaggcagttaaatctagagcattagttgccttgtgcagactcccatgacagccatgtcctagaataatggaacactctggaaatgggctagaatgttgagcagcagcctcccaaatcacagtatgcataaaagccaaaacagatgacagagctcagtaaggaagaccttactatttgtgacatccatcagaattttaacttgagaaactgatttcaaggtttgtttttaaaattcttatatttccttttccatttttcagaaaacactatttcaggctttggtctgacttactggttcgtgggcataaaataatgctattagtgactttaagaactaatgaggctgggcacggtggctcatgcctgcaatccaagcattttgggaggtcgaggccggtggataacgaggtcaggagattgagaccatcctggccaacatggtgaaaccctgtctctactaaaatagaaaaaattaagccaggcgtggtggcgggcgcctgtagtcccagctacttgggaggctgagggaggggaatcgcttgaacccgggtggtggaggttgcagcgagccgagattacaccactgcactccagccttgccaaagaacaagactccatctcaaaaaaaacaaaaacaaaacaaaaaaaaaaacaactaatgaaatgctgtagtatcttaacactggctttctggttttatcattctaagaatcccagagaaaccagggtattcttaggaaagaatggattcctgggaaaataaacatctgcaattaactgtaaacaactgcatcaaagtgttggctttagaatttgaaatgttcctatctgggtttttgtaggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgta

SEQ ID NO: 376459 - DNA, 3749 bp, Homo sapiens
gatttttttttgtgtgtgagataattaggaaagaagatttattgtttacccttgcagtgtttatggggggaaaaggtatttacagaattactgttgctagcgagaatatacagtaaagtttaaaacattttggagaattgattttgattcttaaaatgtgtctttttgcaacatatgctctggttacctataaatacattaatttggcccttgaaaacattcacatcctattctttgttagccttatttttccagtccttgttaactctctcagtgctggataataaacctgcatttcttttaaaacatttgttcagtttcggcatcagtgtcttcccccagcactcccttaatctaaattagtaacattttactgtatgaaaaatagttgctgttaactaaaaattcaataggtgagttagacatggcttttcaagtaggattttcagtggcttcagattccatcatacacaagtgtatgttttttctgtgtaagttttttccgtgtaagttttttccgtgctcaaccgtaagtgctcaaccatcttctccccactttagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggtacgtagtactttggaaactcagtgtgtcatttccaattagttaatgcttgtggtttcattatgctggtcttttggagatttttttaaatcttctttttcaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggtaagaactatgcagaggcggcggcacacacttttaaactgtccttcagttaactgtgtggccttcatatgattttactctcgtaactttaacttactgattcaaactcttaagccatgtgcgacaaaaaaacaagttttaaatacacgtttactatgccttgtatgtacacagcacactctatcaccttggaagctacaagctggtatcattaaatgctgaaaggtaataaagggaacatcttagtggtcttatctctacttgggtatatttttggaaacaatacttgtgatgtttctattactgcctatggctcctatgtaactgaaacaattaatgatctactgatttaaaaaaggcagttaaatctagagcattagttgccttgtgcagactcccatgacagccatgtcctagaataatggaacactctggaaatgggctagaatgttgagcagcagcctcccaaatcacagtatgcataaaagccaaaacagatgacagagctcagtaaggaagaccttactatttgtgacatccatcagaattttaacttgagaaactgatttcaaggtttgtttttaaaattcttatatttccttttccatttttcagaaaacactatttcaggctttggtctgacttactggttcgtgggcataaaataatgctattagtgactttaagaactaatgaggctgggcacggtggctcatgcctgcaatccaagcattttgggaggtcgaggccggtggataacgaggtcaggagattgagaccatcctggccaacatggtgaaaccctgtctctactaaaatagaaaaaattaagccaggcgtggtggcgggcgcctgtagtcccagctacttgggaggctgagggaggggaatcgcttgaacccgggtggtggaggttgcagcgagccgagattacaccactgcactccagccttgccaaagaacaagactccatctcaaaaaaaacaaaaacaaaacaaaaaaaaaaacaactaatgaaatgctgtagtatcttaacactggctttctggttttatcattctaagaatcccagagaaaccagggtattcttaggaaagaatggattcctgggaaaataaacatctgcaattaactgtaaacaactgcatcaaagtgttggctttagaatttgaaatgttcctatctgggtttttgtaggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaaggttagctttatggactactatcattacctttagggtgggaggagggagtaatacacttggtgtaactggtttaagagttgtgtgttcagctgaacctcctaaatataaatgctagaaacaaaattaacttcccacatccccccctaacgtgatcttaatgactttcagagaagtttcccttttggcatgtgttttcacagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttca

SEQ ID NO: 376460 - DNA, 5550 bp, Homo sapiens
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttggatttatgtggcaattgtgtagttgtattcccagtacattaccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccaagtacgtatttatctagcacagtacttcaatatggttcgcatttaatcgttctgcacactgaagcatggagatttattttttccatttattcttactgtacacttttaatatcctaatttctctcggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttca

SEQ ID NO: 376461 - DNA, 7897 bp, Homo sapiens
  misc_feature (1184)..(1184): n is a, c, g, or t
  misc_feature (2847)..(2847): n is a, c, g, or t
  misc_feature (2902)..(2902): n is a, c, g, or t
  misc_feature (4118)..(4118): n is a, c, g, or t
  misc_feature (4546)..(4546): n is a, c, g, or t
  misc_feature (4620)..(4620): n is a, c, g, or t
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttgggtaagtttggtaaatttcatagtagatattttacacattttaaaaaaatcttacgtgtgaattttaaatgattatttttaaattctagatttatgtggcaattgtgtagttgtattcccagtacattaccagatcctaaagctgtgtccttaatgacagcaaaggtaataaatatatgaacttnaaataattctgtcaaaatttactactttaaaatgattgaagcttttttgctttatcttttcttacagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttgcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagaggtaaatattctattgcattttactgtggatattatctcattttaatgttctcaccaagacttactttatagacatttagagtttatggtaaactgttttacaggtggcaaggttttaattatatagatcagtaaacctgaatttatatcccaagaataattaggtcataatttttagggtgctgttcctttttccatagtaattccatacttttcccattattttgtatntagaacagccatttgaaatagactagttttattcatttgtagggacaaaaatganatacatgtgatttcattaagggcacacataatttcccaaaagcctacttatttgacagtatagaaactgaggttaccattgtgaacccggaaaatctgagacaggtctcagttaatttagaaagtttattttgccaaggttgaggacgcgcccgtgacacagcctcaggaagtcctgatggcacgtgcccaaggtggttgggacacagcttgattttatacattttagggagacatgagacatcaatctgtatgtaggaagtacattagctctgtccagaaaggcagagacaacccaaagcaaggcctctccttcctctggggccttcctggtcacaggtatgtgagagacagatggttgcgttcttttgagtttctgataagtctttccaaaggaggcaatcagaatatgcatctatctgggtgagcagagggatgactttgaatagtatgagaggccgatttgccctgagcggttcccagcttgaaggggcccaagatattttcctttcacaccatcctcagaggaaaccagaaggactattacagggttaaaatcagctgtttatgcttcctataattcttgaacatccacaagtatgagatggctgcagagtcaccagaggtacgtgagccctttagtctgataaacatgccaagagtaccataagaattcacaggtaggatgttttttcagttaatgataataaaaaataagagaacaggtttgcactttgaagaatgtggatttgcaaaggtaagggggaaaacatttagataaatgacaataagcactgaggcaaagaaatattggttatgtttgaggaaggctaagtattaaaaaaaaggtaggtgaagaggagtagtaagaatttcattctttaaaatgcaacagatgtttatgctgctttggttgtatttttagaaaaaaaaaatttttttttaatgcaacagatgtttaaatgtctacctctgtgccaagcactgtggtaggtactagggacacagcagtgaacaagacatactggtttctgtccccacagcttacaagttacatactgtacaagtacattgttcatattaggtactgctgcaggttctgggctaagaattttaacatttgaactgtgggtattacagtgtgtaagctgtagtgaactggtggaagaggattcaaagaagggtgctgtatagtaaaataggaaaaaaactaaggncttaattaagctaatacagttaaaggaattaaaagatttaacaagccaatataaaggaaatgaattcctaccttttgcagctctttttacctctttcaggcctactcttttgagtatggctgacagtcactttaccattgtctttggacagagaccctggaaagttggttaaagcagttgcctattctccctaatcttttgtgacctactgctttgtaattttgaagacttaacaatcttagagcaagtacttttttaaaaaaatgtgattaaactatttcttcagactagaatatacacacaaaatagcagagctctgaaggtgaggaatgtttaaaagagcttaatgagagtttaacttcaggatagaaagcaaatacgtttgctttgcacacatgtgcacacacagtctgagtctgaaaacatcnatcgtagaggacgagtactaccattttgtggctcagtaagcaaaaatgaaattaagttttcaattttttcaaancatttgtagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccatttctctcggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggtaagaactatgcagaggcggcggcacacacttttaaactgtccttcagttaactgtgtggccttcatatgattttactctcgtaactttaacttactgattcaaactcttaagccatgtgcgacaaaaaaacaagttttaaatacacgtttactatgccttgtatgtacacagcacactctatcaccttggaagctacaagctggtatcattaaatgctgaaaggtaataaagggaacatcttagtggtcttatctctacttgggtatatttttggaaacaatacttgtgatgtttctattactgcctatggctcctatgtaactgaaacaattaatgatctactgatttaaaaaaggcagttaaatctagagcattagttgccttgtgcagactcccatgacagccatgtcctagaataatggaacactctggaaatgggctagaatgttgagcagcagcctcccaaatcacagtatgcataaaagccaaaacagatgacagagctcagtaaggaagaccttactatttgtgacatccatcagaattttaacttgagaaactgatttcaaggtttgtttttaaaattcttatatttccttttccatttttcagaaaacactatttcaggctttggtctgacttactggttcgtgggcataaaataatgctattagtgactttaagaactaatgaggctgggcacggtggctcatgcctgcaatccaagcattttgggaggtcgaggccggtggataacgaggtcaggagattgagaccatcctggccaacatggtgaaaccctgtctctactaaaatagaaaaaattaagccaggcgtggtggcgggcgcctgtagtcccagctacttgggaggctgagggaggggaatcgcttgaacccgggtggtggaggttgcagcgagccgagattacaccactgcactccagccttgccaaagaacaagactccatctcaaaaaaaacaaaaacaaaacaaaaaaaaaaacaactaatgaaatgctgtagtatcttaacactggctttctggttttatcattctaagaatcccagagaaaccagggtattcttaggaaagaatggattcctgggaaaataaacatctgcaattaactgtaaacaactgcatcaaagtgttggctttagaatttgaaatgttcctatctgggtttttgtaggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaaggttagctttatggactactatcattacctttagggtgggaggagggagtaatacacttggtgtaactggtttaagagttgtgtgttcagctgaacctcctaaatataaatgctagaaacaaaattaacttcccacatccccccctaacgtgatcttaatgactttcagagaagtttcccttttggcatgtgttttcacagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacatccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttca

SEQ ID NO: 376462 - DNA, 5184 bp, Homo sapiens
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttggatttatgtggcaattgtgtagttgtattcccagtacattaccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttca

SEQ ID NO: 376463 - DNA, 7814 bp, Homo sapiens
  misc_feature (1184)..(1184): n is a, c, g, or t
  misc_feature (2847)..(2847): n is a, c, g, or t
  misc_feature (2902)..(2902): n is a, c, g, or t
  misc_feature (4118)..(4118): n is a, c, g, or t
  misc_feature (4546)..(4546): n is a, c, g, or t
  misc_feature (4620)..(4620): n is a, c, g, or t
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttgggtaagtttggtaaatttcatagtagatattttacacattttaaaaaaatcttacgtgtgaattttaaatgattatttttaaattctagatttatgtggcaattgtgtagttgtattcccagtacattaccagatcctaaagctgtgtccttaatgacagcaaaggtaataaatatatgaacttnaaataattctgtcaaaatttactactttaaaatgattgaagcttttttgctttatcttttcttacagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttgcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagaggtaaatattctattgcattttactgtggatattatctcattttaatgttctcaccaagacttactttatagacatttagagtttatggtaaactgttttacaggtggcaaggttttaattatatagatcagtaaacctgaatttatatcccaagaataattaggtcataatttttagggtgctgttcctttttccatagtaattccatacttttcccattattttgtatntagaacagccatttgaaatagactagttttattcatttgtagggacaaaaatganatacatgtgatttcattaagggcacacataatttcccaaaagcctacttatttgacagtatagaaactgaggttaccattgtgaacccggaaaatctgagacaggtctcagttaatttagaaagtttattttgccaaggttgaggacgcgcccgtgacacagcctcaggaagtcctgatggcacgtgcccaaggtggttgggacacagcttgattttatacattttagggagacatgagacatcaatctgtatgtaggaagtacattagctctgtccagaaaggcagagacaacccaaagcaaggcctctccttcctctggggccttcctggtcacaggtatgtgagagacagatggttgcgttcttttgagtttctgataagtctttccaaaggaggcaatcagaatatgcatctatctgggtgagcagagggatgactttgaatagtatgagaggccgatttgccctgagcggttcccagcttgaaggggcccaagatattttcctttcacaccatcctcagaggaaaccagaaggactattacagggttaaaatcagctgtttatgcttcctataattcttgaacatccacaagtatgagatggctgcagagtcaccagaggtacgtgagccctttagtctgataaacatgccaagagtaccataagaattcacaggtaggatgttttttcagttaatgataataaaaaataagagaacaggtttgcactttgaagaatgtggatttgcaaaggtaagggggaaaacatttagataaatgacaataagcactgaggcaaagaaatattggttatgtttgaggaaggctaagtattaaaaaaaaggtaggtgaagaggagtagtaagaatttcattctttaaaatgcaacagatgtttatgctgctttggttgtatttttagaaaaaaaaaatttttttttaatgcaacagatgtttaaatgtctacctctgtgccaagcactgtggtaggtactagggacacagcagtgaacaagacatactggtttctgtccccacagcttacaagttacatactgtacaagtacattgttcatattaggtactgctgcaggttctgggctaagaattttaacatttgaactgtgggtattacagtgtgtaagctgtagtgaactggtggaagaggattcaaagaagggtgctgtatagtaaaataggaaaaaaactaaggncttaattaagctaatacagttaaaggaattaaaagatttaacaagccaatataaaggaaatgaattcctaccttttgcagctctttttacctctttcaggcctactcttttgagtatggctgacagtcactttaccattgtctttggacagagaccctggaaagttggttaaagcagttgcctattctccctaatcttttgtgacctactgctttgtaattttgaagacttaacaatcttagagcaagtacttttttaaaaaaatgtgattaaactatttcttcagactagaatatacacacaaaatagcagagctctgaaggtgaggaatgtttaaaagagcttaatgagagtttaacttcaggatagaaagcaaatacgtttgctttgcacacatgtgcacacacagtctgagtctgaaaacatcnatcgtagaggacgagtactaccattttgtggctcagtaagcaaaaatgaaattaagttttcaattttttcaaancatttgtagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccatttctctcggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggtaagaactatgcagaggcggcggcacacacttttaaactgtccttcagttaactgtgtggccttcatatgattttactctcgtaactttaacttactgattcaaactcttaagccatgtgcgacaaaaaaacaagttttaaatacacgtttactatgccttgtatgtacacagcacactctatcaccttggaagctacaagctggtatcattaaatgctgaaaggtaataaagggaacatcttagtggtcttatctctacttgggtatatttttggaaacaatacttgtgatgtttctattactgcctatggctcctatgtaactgaaacaattaatgatctactgatttaaaaaaggcagttaaatctagagcattagttgccttgtgcagactcccatgacagccatgtcctagaataatggaacactctggaaatgggctagaatgttgagcagcagcctcccaaatcacagtatgcataaaagccaaaacagatgacagagctcagtaaggaagaccttactatttgtgacatccatcagaattttaacttgagaaactgatttcaaggtttgtttttaaaattcttatatttccttttccatttttcagaaaacactatttcaggctttggtctgacttactggttcgtgggcataaaataatgctattagtgactttaagaactaatgaggctgggcacggtggctcatgcctgcaatccaagcattttgggaggtcgaggccggtggataacgaggtcaggagattgagaccatcctggccaacatggtgaaaccctgtctctactaaaatagaaaaaattaagccaggcgtggtggcgggcgcctgtagtcccagctacttgggaggctgagggaggggaatcgcttgaacccgggtggtggaggttgcagcgagccgagattacaccactgcactccagccttgccaaagaacaagactccatctcaaaaaaaacaaaaacaaaacaaaaaaaaaaacaactaatgaaatgctgtagtatcttaacactggctttctggttttatcattctaagaatcccagagaaaccagggtattcttaggaaagaatggattcctgggaaaataaacatctgcaattaactgtaaacaactgcatcaaagtgttggctttagaatttgaaatgttcctatctgggtttttgtaggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaaggttagctttatggactactatcattacctttagggtgggaggagggagtaatacacttggtgtaactggtttaagagttgtgtgttcagctgaacctcctaaatataaatgctagaaacaaaattaacttcccacatccccccctaacgtgatcttaatgactttcagagaagtttcccttttggcatgtgttttcacagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacatccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgta

SEQ ID NO: 376464 - DNA, 2452 bp, Homo sapiens
  misc_feature (168)..(168): n is a, c, g, or t
cattggtccgagagaaattaggaaattgggagggtggaagaggataagagggtgtgtgatacttgagtttgagctctcataggtagacagttggagttgatgaaaaggtcaaaggtaaggccatgggaattagttctcagtggagcttatgtgaatgctaatttctcncggagccggtccattggtccgagagaaattagaaatgcctgtatagatgtcctcaaggaacttgtacttttgagtccccatgattttcttcatactctggttccctttctacaacacaaccattgtacttaccatcacagtaatataccaagtacgtatttatctagcacagtacttcaatatggttcgcatttaatcgttctgcacactgaagcatggagatttattttttccatttattcttactgtacacttttaatatcctaatttctctcggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttca

SEQ ID NO: 376465 - DNA, 1888 bp, Homo sapiens
aaaatatagaaaatatgcagttatgactagaaatagctgtaatattgtacctgcagagttgagtatctcactagtataatttataattataacctattctgatttcttttcaaatattaggtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttca

SEQ ID NO: 376466 - DNA, 831 bp, Homo sapiens
gcctactactactactaaattcgcggccgcgtcgacggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttca

SEQ ID NO: 376467 - DNA, 3853 bp, Homo sapiens
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttggatttatgtggcaattgtgtagttgtattcccagtacattaccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccatttctctcggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagaacgtgtagacaatgttgttgtttaaaaaagttctttcatccattagatacattaacgggatcctgaa

SEQ ID NO: 376468 - DNA, 878 bp, Homo sapiens
gatttttttttgtgtgtgagataattaggaaagaagatttattgtttacccttgcagtgtttatggggggaaaaggtatttacagaattactgttgctagcgagaatatacagtaaagtttaaaacattttggagaattgattttgattcttaaaatgtgtctttttgcaacatatgctctggttacctataaatacattaatttggcccttgaaaacattcacatcctattctttgttagccttatttttccagtccttgttaactctctcagtgctggataataaacctgcatttcttttaaaacatttgttcagtttcggcatcagtgtcttcccccagcactcccttaatctaaattagtaacattttactgtatgaaaaatagttgctgttaactaaaaattcaataggtgagttagacatggcttttcaagtaggattttcagtggcttcagattccatcatacacaagtgtatgttttttctgtgtaagttttttccgtgtaagttttttccgtgctcaaccgtaagtgctcaaccatcttctccccactttagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccaaccagccgcatccgccagtctctgatgaagtaagcaaacagtgcagcagcatatagccaactgccaaaaactgtgcacactcccaacgatcgagacatagca

SEQ ID NO: 376469 - DNA, 2036 bp, Homo sapiens
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttggatttatgtggcaattgtgtagttgtattcccagtacattaccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggtgaaatgtttcgaatttaaaatgtttaaagcatgtttggttttattatttttacataattgtttaccactagtttttccactagctttttattatatatgtttaattatgtaattgttattcactagcttttattatataattccttttaaataatactactattcatcaactcttgtggcataagaatttcagttttttctaccaaacttttacttcatctatgagtcgtgttagaaatagtcattgaaaaaatatacagtaaaatatctagcaaaataga

SEQ ID NO: 376470 - DNA, 2322 bp, Homo sapiens
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttggatttatgtggcaattgtgtagttgtattcccagtacattaccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttgtaagtcaaatatttagaatttcataaaccatttatttattgttcaaagttatgtttcattttgtttttaggcaactacgacatgcccattgttgtatactacgaaattcttggaga

SEQ ID NO: 376471 - DNA, 5433 bp, Homo sapiens
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttggatttatgtggcaattgtgtagttgtattcccagtacattaccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccatttctctcggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttca

SEQ ID NO: 376472 - DNA, 3838 bp, Homo sapiens
cctgtaatcccagcactttgggaggccaaggcgggaggatcgcttgagcctaggagtttgagaccagcctaggcaacatagtgagaacccgtctctacacaaaatagaaaaatctagccgggtgtagtggcacatgcctgtagtcccagccactcggaggctgaggcaggaggatcgcttgagcctgagaagtggaggctgcagtgagctgtgatctcgccactgcatcccagcctgggtgacatagcgaaaccctgtctcaaaaacaaaacaaaacaagaatatcctgaaatcctcctctttctgttttagattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccatttctctcggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttca

SEQ ID NO: 376473 - DNA, 2088 bp, Homo sapiens
ccaggtgtacgctcggttccgggatgtgctgctgctcctttgcaccttactgtatgactcctggcaggtatgatgccttgacggcatttgtttcaacagaccaagatgtgatgggagtcattaggcagctggagtgagcagcctagggtctgcccctccattgttgagctcttcttgattactagtagcattccactgcttaaaatgcctgtatagatgtcctcaaggaacttgtacttttgagtccccatgattttcttcatactctggttccctttctacaacacaaccattgtacttaccatcacagtaatataccagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttca

SEQ ID NO: 376474 - DNA, 1483 bp, Homo sapiens
gcggagcgtcaaacgggtagagctacagtcggattcgccatccgagtgagattccaaagcacgtgcttctgttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttttca

SEQ ID NO: 376475 - DNA, 4654 bp, Homo sapiens
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttggatttatgtggcaattgtgtagttgtattcccagtacattaccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccatttctctcggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcaggtaaagaaaatgagttttagatgattggtctttaatcttatctgaccaagtggtcaataattttaggaacagtgggttgaagacttgctgaaaagtggggacattttagaatcttgataggtaacatatgaatgaatgaaaatactagctattacatattaggcatctagtttccctttgatttttttaacttaagtagatttctatcatagaggatattttaaataagctggttataattgaatttctcatttatagatgtatatcaacagttgtggggaaaatccaaaacagggagatagtgggggaaaaggcacttgccacttcttcctctccttcacctccctgtctctacctcttttccaccattccaaaacctctagcagaaaccctgtcagcagtctgtcctttagcttttcataatctgtagtttttcaggggtctgatgcacttgttttcttacagcgatctccttgaaaacaggaaagattactgttcctaccttaagtgtctaagagccaactccttaaaattaagtggctgcataaataatgcttgttaagttacaaaggcagaattgggaagaggaggaggtactaatgtttggctcattccttggatcaggcataaaggatccccactacctttcagtccctgaaaaaactgttgattgtactgcctggttgcatctgctctaccccattggaagagatgaatttattcaccttccttaggtgcaacccttgacccacatcatgctttcctgaagtattttgagtctggttcagcctcctaccaggctgtagtgtgctctggattctcctagatgtttgccatcctgtactctactggtggtttctctacttttccaaaacagaactcaagtgtagagaccttatcagagtcatc

SEQ ID NO: 376476 - DNA, 970 bp, Homo sapiens
  misc_feature (951)..(951): n is a, c, g, or t
aggagagtgaatgcaaagcatataatcctagacctgtctgtaaaacatacaccatggataagcagcctctgaatactgggggacagaaagatatgacagagttttttactgatctaattaccaaaatcgaagaaatgtctcccgaactgaaaaataccgtcaaaagtttatttggaggtgtaattacaaacaatgtcgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggatgagctggaacagtgaatgaagattattttttttccaagaagtttagttttcaaagatgaacctnagagagtctccgtcgaact

SEQ ID NO: 376477 - DNA, 627 bp, Homo sapiens
tctacagtctgtggagacaggtgagcgacgaacttctgagacagttgtgtccctgtggctttggtgcgcctgtgtgcactttctccctccacctggagcatgggctaacaccggaggaaaggaaaagacagagtcagacagggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgctatgaagccttttgaagtgccagtcttatttgacacgcagggccggttgggtgtgggacgttagaaattccctagttgcctgccctccaatgacggttatgaacccacacccatctcccctgacttacatgcaactggttgtgttgataccccccccaggccacccttgcgcgagggaaccacactaaggcaatcccaaatgggggtcccagtgactacgga

SEQ ID NO: 376478 - DNA, 2881 bp, Homo sapiens
tctacagtctgtggagacaggtgagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccacctggagcatgggctaacaccggaggaaaggaaaagacagagtcagacagggtaagtggggctccctcccctcttctctctaacggggctggattgagggcctctggctggggaggtgggggtggagatccagtaggagcaataacagaggaagggcagggcctgccccatcacctgaattccagagatgccagtgtgcactgaagccccaggcagggcgtgcccaggaccggatcctggatggtggtaagggacaaagctggaagggagactacagggaaggagaaaggaaagaaggcagagccatgacacagtcaacttacagaatggctgggagtcaaagctcctgggctggtttcctggctattccacacactccaagacatagagagaatttcggaactggaggggactctacagatgatttatttgagattgaagaacctagaaaccaaacaaagaaatatcatatggttactttggtatctgacacagccatgacaccaattgctagtgtagacacaatagctgtgtgtctttttgcaggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagccaaaaaaaaa

SEQ ID NO: 376479 - DNA, 1775 bp, Homo sapiens
tctacagtctgtggagacaggtgagcgacgaacttctgagacagttgtgtccctgtggctttggtgcgcctgtgtgcactttctccctccacctggagcatgggctaacaccggaggaaaggaaaagacagagtcagacaggggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagccaaaaaaaaa

SEQ ID NO: 376480 - DNA, 1677 bp, Homo sapiens
tctacagtctgtggagacaggtgagcgacgaacttctgagacagggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagccaaaaaaaaa

SEQ ID NO: 376481 - DNA, 2261 bp, Homo sapiens
tctacagtctgtggagacaggtgagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccacctggagcatgggctaacaccggaggaaaggaaaagacagagtcagacagggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagccaaaaaaaaa

SEQ ID NO: 376482 - DNA, 1404 bp, Homo sapiens
tctacagtctgtggagacaggtgagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccacctggagcatgggctaacaccggaggaaaggaaaagacagagtcagacagggtaagtggggctccctcccctcttctctctaacggggctggattgagggcctctggctggggaggtgggggtggagatccagtaggagcaataacagaggaagggcagggcctgccccatcacctgaattccagagatgccagtgtgcactgaagccccaggcagggcgtgcccaggaccggatcctggatggtggtaagggacaaagctggaagggagactacagggaaggagaaaggaaagaaggcagagccatgacacagtcaacttacagaatggctgggagtcaaagctcctgggctggtttcctggctattccacacactccaagacatagagagaatttcggaactggaggggactctacagatgatttatttgagattgaagaacctagaaaccaaacaaagaaatatcatatggttactttggtatctgacacagccatgacaccaattgctagtgtagacacaatagctgtgtgtctttttgcaggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgtgagttaagggtgggcatcgtaagaggaatacaccttgggcccatcctccctctctccctgtagtctctgaggcagagagtctctggtttcctgtcattggcatcagcgggaggaggggtcagaggccaacagaggatcttttgcccacagcagac

SEQ ID NO: 376483 - DNA, 2386 bp, Homo sapiens
tctacagtctgtggagacaggtgagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccacctggagcatgggctaacaccggaggaaaggaaaagacagagtcagacagggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagccaaaaaaaaa

SEQ ID NO: 376484 - DNA, 2124 bp, Homo sapiens
tctacagtctgtggagacaggtgagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccacctggagcatgggctaacaccggaggaaaggaaaagacagagtcagacaggggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagccaaaaaaaaa

SEQ ID NO: 376485 - DNA, 2304 bp, Homo sapiens
tctacagtctgtggagacaggtgagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccacctggagcatgggctaacaccggaggaaaggaaaagacagagtcagacagggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccaaccgttcaacttcaataaagcaaaactccagccaaaaaaaaa

SEQ ID NO: 376486 - DNA, 309 bp, Homo sapiens
ctctcatcttccataattttttggtgttaagattaaaacagattgcacagccaatataagggcacataagctgcccagagtacagtttggcccttaaagagaaattttcattcattgtctttatcagcactcctcaatcaggtaaatgaagataaacttgcccctaaattcctaaggctctcagcccaatttccagtattgtacttagcagacagggtgtggaattttcaaacggtaagtggcaaggaacatcaattaatccagtggagaagccctcatctctctggcaccaaagacagtgacattagg

SEQ ID NO: 376487 - DNA, 788 bp, Homo sapiens
tcaggtagtatgtggtctgattctaactcaacaacttgcagaaactcacttcttttttctttttttttccccaggaggagctatcgtattaactgacgaaactcacttcatttctttggacctgcaaaatgaggatgggctctaaaccacctctaaagttaatattctatgattccatgataaggctatttgtcatttataaaaaaaggaacttccacatagcccagagaaaggaaatgactttttcaagtttacagagtcaattaatggacgaaatataatttgaaattcaatctcctgatccccagtctattgggagttctttcagaatgtcccttgactgtccctcaaagtgccagcatgtatgaaaccttgttaaggatgtatgctcaatgaaaatacacaaattgacttaacaagaaactaaactctccagaaagatgcagttgacccaaaactctgaatatcttttatgtttaaaactttcttttttgaacaaaattgtacagttacttctctatttcaactcttaagccttttatgccacgtcaaaggttagctctcttttctctctgttaataaagtcttattcttgactttggaactgtatgccaagctaaggggtcctttattgtttatttattttttgattctctacttttgattcacacatcttttctacaagaaagacaatttatagcaggggcatattactttctttgggcctctgtgtccttatctatagccaaaaggtatggaaataaatgttttctaaaggtctttctggc

SEQ ID NO: 376488 - DNA, 427 bp, Homo sapiens
ggggggaacctagggcctcctatcgcatgatcccccatggcctccctcagcctctcttggtttgggcaggcatggcctcctcttctctccagtccccacccagactgctctcctcctctgtcccctgcgatcttcagccaacccgcatgctgaaaggggtgccgacctgggccctggggggaggcatggagggaggggtccccagtggcttggcctgaagaaggttgacgtctgccgtggcccagagctgagtcaccgaccctgcgtctgtcctgtgcagctgccaaggctgtcagctttcctcagcaacatgaagtctcggtaagggttcttctgtgtctagctgccggcccctgcctgtcctgatccgagtctgggtctgggtagtttctgacaggaaaggacttgagggaagtagcctctgagg

SEQ ID NO: 376489 - DNA, 2683 bp, Homo sapiens
tgatccagtccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcagcaagagtggcctgaagggctgtgtctatggacaggaggcagtgcgtctctccgtgggccccatggcccgggacgtggagagcctggcactgtgcctgcgagccctgctgtgcgaggacatgttccgcttggaccccactgtgcctcccttgcccttcagagaagaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgttcggctggaaaactctgggaactgcagcacgagatcgaggtgtaccgcaaaaccgtgattgcccagtggagggcgctggacctggatgtggtgctgacccccatgctggcccctgctctggacttgaatgccccaggcagggccacaggggccgtcagctacactatgctgtacaactgcctggacttccctgcaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacaaaaaaaaaaaaaaaaaaaaaaaaaaaaaaaaaaaaaaaaaaaaaaaaaaaaaaaaaaaaaaaaaaaaaaaaaaaaaaagagaggggcgcgcgcgcgcgtcctcatcagtatcgtctctctccctgcgtggggcggaccctactagtcccctcctcgccgccccgcgctcttttctgtttctatcagcgggcgctccgccctctctgctagtgggcgtcgttctttatttacgcgcgcgcgggacgacacgcgcggcgacgcgcgtcattcgtctttctcccacccgctcgcgatcgcggcgcgctgagtggaacaacagacagacgggaggctcacggaggggcgctcactcctcctcgctgctggtagtacaaccgcggccgccggcgcgccggccgccatcctatgcagtatcctgctgctccagtgggagagcggggcggcggtggaggaggaccagaaaatagtgctgcggtggcgggcgcagaagatcttctcttatctcccgtgcggggaggggtatagttttctctacgaggggcgcgcgctcttgcgcagggggggcgcggggatagtgggtcta

SEQ ID NO: 376490 - DNA, 2603 bp, Homo sapiens
ggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcagcaagagtggcctgaagggctgtgtctatggacaggaggcagtgcgtctctccgtgggccccatggcccgggacgtggagagcctggcactgtgcctgcgagccctgctgtgcgaggacatgttccgcttggaccccactgtgcctcccttgcccttcagagaagaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgttcggctggaaaactctgggaactgcagcacgagatcgaggtgtaccgcaaaaccgtgattgcccagtggagggcgctggacctggatgtggtgctgacccccatgctggcccctgctctggacttgaatgccccaggcagggccacaggggccgtcagctacactatgctgtacaactgcctggacttccctgcaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacaaaaaaaaaaaaaaaaaaaaaaaaaaaaaaaaaaaaaaaaaaaaaaaaaaaaaaaaaaaaaaaaaaaaaaaaaaaaaaagagaggggcgcgcgcgcgcgtcctcatcagtatcgtctctctccctgcgtggggcggaccctactagtcccctcctcgccgccccgcgctcttttctgtttctatcagcgggcgctccgccctctctgctagtgggcgtcgttctttatttacgcgcgcgcgggacgacacgcgcggcgacgcgcgtcattcgtctttctcccacccgctcgcgatcgcggcgcgctgagtggaacaacagacagacgggaggctcacggaggggcgctcactcctcctcgctgctggtagtacaaccgcggccgccggcgcgccggccgccatcctatgcagtatcctgctgctccagtgggagagcggggcggcggtggaggaggaccagaaaatagtgctgcggtggcgggcgcagaagatcttctcttatctcccgtgcggggaggggtatagttttctctacgaggggcgcgcgctcttgcgcagggggggcgcggggatagtgggtcta

SEQ ID NO: 376491 - DNA, 2652 bp, Homo sapiens
tgatccagtccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcagcaagagtggcctgaagggctgtgtctatggacaggaggcagtgcgtctctccgtgggccccatggcccgggacgtggagagcctggcactgtgcctgcgagccctgctgtgcgaggacatgttccgcttggaccccactgtgcctcccttgcccttcagagaagaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgttcggctggaaaactctgggaactgcagcacgagatcgaggtgtaccgcaaaaccgtgattgcccagtggagggcgctggacctggatgtggtgctgacccccatgctggcccctgctctggacttgaatgccccaggcagggccacaggggccgtcagctacactatgctgtacaactgcctggacttccctgcaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacaaaaaaaaaaaaaaaaaaaaaaaaaaaaaaaaaaaaaaaaaaaaaaaaaaaaaaaaaaaaaaaaaaaaaaaaaaaaaaagagaggggcgcgcgcgcgcgtcctcatcagtatcgtctctctccctgcgtggggcggaccctactagtcccctcctcgccgccccgcgctcttttctgtttctatcagcgggcgctccgccctctctgctagtgggcgtcgttctttatttacgcgcgcgcgggacgacacgcgcggcgacgcgcgtcattcgtctttctcccacccgctcgcgatcgcggcgcgctgagtggaacaacagacagacgggaggctcacggaggggcgctcactcctcctcgctgctggtagtacaaccgcggccgccggcgcgccggccgccatcctatgcagtatcctgctgctccagtgggagagcggggcggcggtggaggaggaccagaaaatagtgctgcggtggcgggcgcagaagatcttctcttatctcccgtgcggggaggggtatagttttctctacgaggggcgcgcgctcttgcgcagggggggcgcggggatagtgggtcta

SEQ ID NO: 376492 - DNA, 2635 bp, Homo sapiens
tgatccagtccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcagcaagagtggcctgaagggctgtgtctatggacaggaggcagtgcgtctctccgtgggccccatggcccgggacgtggagagcctggcactgtgcctgcgagccctgctgtgcgaggacatgttccgcttggaccccactgtgcctcccttgcccttcagagaagaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgttcggctggaaaactctgggaactgcagcacgagatcgaggtgtaccgcaaaaccgtgattgcccagtggagggcgctggacctggatgtggtgctgacccccatgctggcccctgctctggacttgaatgccccaggcagggccacaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacaaaaaaaaaaaaaaaaaaaaaaaaaaaaaaaaaaaaaaaaaaaaaaaaaaaaaaaaaaaaaaaaaaaaaaaaaaaaaaagagaggggcgcgcgcgcgcgtcctcatcagtatcgtctctctccctgcgtggggcggaccctactagtcccctcctcgccgccccgcgctcttttctgtttctatcagcgggcgctccgccctctctgctagtgggcgtcgttctttatttacgcgcgcgcgggacgacacgcgcggcgacgcgcgtcattcgtctttctcccacccgctcgcgatcgcggcgcgctgagtggaacaacagacagacgggaggctcacggaggggcgctcactcctcctcgctgctggtagtacaaccgcggccgccggcgcgccggccgccatcctatgcagtatcctgctgctccagtgggagagcggggcggcggtggaggaggaccagaaaatagtgctgcggtggcgggcgcagaagatcttctcttatctcccgtgcggggaggggtatagttttctctacgaggggcgcgcgctcttgcgcagggggggcgcggggatagtgggtcta

SEQ ID NO: 376493 - DNA, 1598 bp, Homo sapiens
ggggggaacctagggcctcctatcgcatgatcccccatggcctccctcagcctctcttggtttgggcaggcatggcctcctcttctctccagtccccacccagactgctctcctcctctgtcccctgcgatcttcagccaacccgcatgctgaaaggggtgccgacctgggccctggggggaggcatggagggaggggtccccagtggcttggcctgaagaaggttgacgtctgccgtggcccagagctgagtcaccgaccctgcgtctgtcctgtgcagctgccaaggctgtcagctttcctcagcaacatgaagtctcgttcggctggaaaactctgggaactgcagcacgagatcgaggtgtaccgcaaaaccgtgattgcccagtggagggcgctggacctggatgtggtgctgacccccatgctggcccctgctctggacttgaatgccccaggcagggccacaggggccgtcagctacactatgctgtacaactgcctggacttccctgcaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacaaaaaaaaaaaaaaaaaaaaaaaaaaaaaaaaaaaaaaaaaaaaaaaaaaaaaaaaaaaaaaaaaaaaaaaaaaaaaaagagaggggcgcgcgcgcgcgtcctcatcagtatcgtctctctccctgcgtggggcggaccctactagtcccctcctcgccgccccgcgctcttttctgtttctatcagcgggcgctccgccctctctgctagtgggcgtcgttctttatttacgcgcgcgcgggacgacacgcgcggcgacgcgcgtcattcgtctttctcccacccgctcgcgatcgcggcgcgctgagtggaacaacagacagacgggaggctcacggaggggcgctcactcctcctcgctgctggtagtacaaccgcggccgccggcgcgccggccgccatcctatgcagtatcctgctgctccagtgggagagcggggcggcggtggaggaggaccagaaaatagtgctgcggtggcgggcgcagaagatcttctcttatctcccgtgcggggaggggtatagttttctctacgaggggcgcgcgctcttgcgcagggggggcgcggggatagtgggtcta

SEQ ID NO: 376494 - DNA, 2304 bp, Homo sapiens
tgatccagtccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcagcaagagtggcctgaagggctgtgtctatggacaggaggcagtgcgtctctccgtgggccccatggcccgggacgtggagagcctggcactgtgcctgcgagccctgctgtgcgaggacatgttccgcttggaccccactgtgcctcccttgcccttcagagaagaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgttcggctggaaaactctgggaactgcagcacgagatcgaggtgtaccgcaaaaccgtgattgcccagtggagggcgctggacctggatgtggtgctgacccccatgctggcccctgctctggacttgaatgccccaggcagggccacaggggccgtcagctacactatgctgtacaactgcctggacttccctgcaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatcccagcagtcaccgtggtgacaggcaccaccccgtcgggtggagcgctccacccgacggggtgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgactagcctca

SEQ ID NO: 376495 - DNA, 2008 bp, Homo sapiens
tgatccagtccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcagcaagagtggcctgaagggctgtgtctatggacaggaggcagtgcgtctctccgtgggccccatggcccgggacgtggagagcctggcactgtgcctgcgagccctgctgtgcgaggacatgttccgcttggaccccactgtgcctcccttgcccttcagagaagaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgttcggctggaaaactctgggaactgcagcacgagatcgaggtgtaccgcaaaaccgtgattgcccagtggagggcgctggacctggatgtggtgctgacccccatgctggcccctgctctggacttgaatgccccaggcagggccacaggggccgtcagctacactatgctgtacaactgcctggacttccctgcaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagccccacactcttcttcatgcccttctgcagcatcttgtcccagatatccccaaagtagcccctgtaatgttccatctgggcctcgtcctcagcagtcaccgtggtgaacaggcaccacctctgcaaggaacccacg

SEQ ID NO: 376496 - DNA, 1524 bp, Homo sapiens
tgatccagtccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcagctccacccccatgtggcagcccatgggtatgacataggccaaggcccaactaacagtcaagaaacaaaaaaaaaaaaaaaaaaaaaaaaaaaaaaaaaaaaaaaaaaaaaaaaaaaaaaaaaaaaaaaaaaaaaaaaaaaaaaagagaggggcgcgcgcgcgcgtcctcatcagtatcgtctctctccctgcgtggggcggaccctactagtcccctcctcgccgccccgcgctcttttctgtttctatcagcgggcgctccgccctctctgctagtgggcgtcgttctttatttacgcgcgcgcgggacgacacgcgcggcgacgcgcgtcattcgtctttctcccacccgctcgcgatcgcggcgcgctgagtggaacaacagacagacgggaggctcacggaggggcgctcactcctcctcgctgctggtagtacaaccgcggccgccggcgcgccggccgccatcctatgcagtatcctgctgctccagtgggagagcggggcggcggtggaggaggaccagaaaatagtgctgcggtggcgggcgcagaagatcttctcttatctcccgtgcggggaggggtatagttttctctacgaggggcgcgcgctcttgcgcagggggggcgcggggatagtgggtcta

SEQ ID NO: 376497 - DNA, 2353 bp, Homo sapiens
tgatccagtccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgttcggctggaaaactctgggaactgcagcacgagatcgaggtgtaccgcaaaaccgtgattgcccagtggagggcgctggacctggatgtggtgctgacccccatgctggcccctgctctggacttgaatgccccaggcagggccacaggggccgtcagctacactatgctgtacaactgcctggacttccctgcaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacaaaaaaaaaaaaaaaaaaaaaaaaaaaaaaaaaaaaaaaaaaaaaaaaaaaaaaaaaaaaaaaaaaaaaaaaaaaaaaagagaggggcgcgcgcgcgcgtcctcatcagtatcgtctctctccctgcgtggggcggaccctactagtcccctcctcgccgccccgcgctcttttctgtttctatcagcgggcgctccgccctctctgctagtgggcgtcgttctttatttacgcgcgcgcgggacgacacgcgcggcgacgcgcgtcattcgtctttctcccacccgctcgcgatcgcggcgcgctgagtggaacaacagacagacgggaggctcacggaggggcgctcactcctcctcgctgctggtagtacaaccgcggccgccggcgcgccggccgccatcctatgcagtatcctgctgctccagtgggagagcggggcggcggtggaggaggaccagaaaatagtgctgcggtggcgggcgcagaagatcttctcttatctcccgtgcggggaggggtatagttttctctacgaggggcgcgcgctcttgcgcagggggggcgcggggatagtgggtcta

SEQ ID NO: 376498 - DNA, 2429 bp, Homo sapiens
tgatccagtccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcggtgtaccgcaaaaccgtgattgcccagtggagggcgctggacctggatgtggtgctgacccccatgctggcccctgctctggacttgaatgccccaggcagggccacaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacaaaaaaaaaaaaaaaaaaaaaaaaaaaaaaaaaaaaaaaaaaaaaaaaaaaaaaaaaaaaaaaaaaaaaaaaaaaaaaagagaggggcgcgcgcgcgcgtcctcatcagtatcgtctctctccctgcgtggggcggaccctactagtcccctcctcgccgccccgcgctcttttctgtttctatcagcgggcgctccgccctctctgctagtgggcgtcgttctttatttacgcgcgcgcgggacgacacgcgcggcgacgcgcgtcattcgtctttctcccacccgctcgcgatcgcggcgcgctgagtggaacaacagacagacgggaggctcacggaggggcgctcactcctcctcgctgctggtagtacaaccgcggccgccggcgcgccggccgccatcctatgcagtatcctgctgctccagtgggagagcggggcggcggtggaggaggaccagaaaatagtgctgcggtggcgggcgcagaagatcttctcttatctcccgtgcggggaggggtatagttttctctacgaggggcgcgcgctcttgcgcagggggggcgcggggatagtgggtcta

SEQ ID NO: 376499 - DNA, 1764 bp, Homo sapiens
gatttccccacctgtgcctccaggctgtacctccctaaggggaggtaccctcagggaggcctcatcagggagatgttgccctcagttcttagagctctgagctgggtttgctggagagggataccctgagtcctgccttggggagctcccgtggatgtgggttgcagcccaggcatcccaaaggatcagcagaaacaaacggcatgtttggaaggagggagctgagtctggtgaggaggaggtggacaggatccctgcatagagaatgggattgctgtgggccgggcgagcaagctgggaaggatgtggggatgggagtgcctggaccgagcattttgtttcccagcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgttcggctggaaaactctgggaactgcagcacgagatcgaggtgtaccgcaaaaccgtgattgcccagtggagggcgctggacctggatgtggtgctgacccccatgctggcccctgctctggacttgaatgccccaggcagggccacaggggccgtcagctacactatgctgtacaactgcctggacttccctgcaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacaaaaaaaaaaaaaaaaaaaaaaaaaaaaaaaaaaaaaaaaaaaaaaaaaaaaaaaaaaaaaaaaaaaaaaaaaaaaaaagagaggggcgcgcgcgcgcgtcctcatcagtatcgtctctctccctgcgtggggcggaccctactagtcccctcctcgccgccccgcgctcttttctgtttctatcagcgggcgctccgccctctctgctagtgggcgtcgttctttatttacgcgcgcgcgggacgacacgcgcggcgacgcgcgtcattcgtctttctcccacccgctcgcgatcgcggcgcgctgagtggaacaacagacagacgggaggctcacggaggggcgctcactcctcctcgctgctggtagtacaaccgcggccgccggcgcgccggccgccatcctatgcagtatcctgctgctccagtgggagagcggggcggcggtggaggaggaccagaaaatagtgctgcggtggcgggcgcagaagatcttctcttatctcccgtgcggggaggggtatagttttctctacgaggggcgcgcgctcttgcgcagggggggcgcggggatagtgggtcta

SEQ ID NO: 376500 - DNA, 1302 bp, Homo sapiens
tggtgaccacactccttctgcccagttcggctggaaaactctgggaactgcagcacgagatcgaggtgtaccgcaaaaccgtgattgcccagtggagggcgctggacctggatgtggtgctgacccccatgctggcccctgctctggacttgaatgccccaggcagggccacaggggccgtcagctacactatgctgtacaactgcctggacttccctgcaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacaaaaaaaaaaaaaaaaaaaaaaaaaaaaaaaaaaaaaaaaaaaaaaaaaaaaaaaaaaaaaaaaaaaaaaaaaaaaaaagagaggggcgcgcgcgcgcgtcctcatcagtatcgtctctctccctgcgtggggcggaccctactagtcccctcctcgccgccccgcgctcttttctgtttctatcagcgggcgctccgccctctctgctagtgggcgtcgttctttatttacgcgcgcgcgggacgacacgcgcggcgacgcgcgtcattcgtctttctcccacccgctcgcgatcgcggcgcgctgagtggaacaacagacagacgggaggctcacggaggggcgctcactcctcctcgctgctggtagtacaaccgcggccgccggcgcgccggccgccatcctatgcagtatcctgctgctccagtgggagagcggggcggcggtggaggaggaccagaaaatagtgctgcggtggcgggcgcagaagatcttctcttatctcccgtgcggggaggggtatagttttctctacgaggggcgcgcgctcttgcgcagggggggcgcggggatagtgggtcta

SEQ ID NO: 376501 - DNA, 1601 bp, Homo sapiens
tgatccagtccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcagcaggtaaggtgggtggagggcgcttctgggcccctcgctgtgtgaccttggcctagcttccaacctctctgggctccaggcggggattcggtctccggggttttgctgggaggaagcattacagtaccactggccgggcgtgggtcctagtttccaaagcggtgagtgttcagagctgctctgtgggtgtggggatggcggcgggtggccatttcctgtttccagcatcttatgtttcttatccagcaagagtggcctgaagggctgtgtctatggacaggaggcagtgcgtctctccgtgggccccatggcccgggacgtggagagcctggcactgtgcctgcgagccctgctgtgcgaggacatgttccgcttggaccccactgtgcctcccttgcccttcagagaagaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttgtgagtgatagtgggctttggggtcttggtgggatcagacaagtaggcagacctgggggagcagcagggtgtggtgatgcctggatgggc

SEQ ID NO: 376502 - DNA, 654 bp, Homo sapiens
agctgttcagaggatcccaaagattttgagcatcaccctcagactgacactgctgaggagccgggggcggttagctgcaggtgtgcctggctgggtactgagtggaaagccttgggccagaatcttcatagaagtctagagttggggagagttggagggtatgttagtgaagggtgtatacacctggaggctccccaggccctccactctcgctctgctcttcggttgaggcagatggcactgctggctgtggagggcctgattggtaccaccttccccggcgttatgatggagcagggacgacaggctctggcttggggacccaaagttggcatgcagctaattatttaacagcatccagtccttttggcccctaggtaccggaattatatatgaataataagcacatacgatggaattactcaaatggagaactgaccaggctactaacaatagagtccagattggaaaagaagcactgtggaataacttgtgagaggattctgtgctaaattagaactttttcaaaggtggcctgaaaagaggggacttcagtttaattccagagatggtaattctggggacgtgttttacttggagctggacttcttgtgacgtggtgatgctcaaagatcttggggtacgagctcgaat

SEQ ID NO: 376503 - DNA, 174 bp, Homo sapiens
taaaaatacaaaattagcagggcgcggtggcaggcgcgctgccactgtggagcagttcgttttgaagtttgggcctcagcagacttgcatatatttgactgcaagtgagtatttttttttccctaaattggcttaaaagaatttcagagttaaaatgcaatatttcaaaataat

SEQ ID NO: 376504 - DNA, 1758 bp, Homo sapiens
gaggagctctgcggccgccaagctgcgcgggcagaagcggtccggggcctccgcggcccccgcggcctccgcggccgctgccttggcacccagcgccacccgcacacggcgctccgctagccaggccgggagcaagagccaggcggtggagaagccgccgtcggagaagccgcggctgaggcgctcgtcgccgcgggcccaggaggagggcccgggggagccgccgccgcctgagctggcgttgctcccgccaccgccgccgccgccgccgactcccgcgaccccgacgtcctcggcgtccaacctggacctgggcgagcagcgggagcgctgggagacgttccagaagcggcagaagcttacctccgagggtgccgccaagctcctgctagacacctttgaataccagggcctggtgaagcacacaggaggctgccactgtggagcagttcgttttgaagtttgggcctcagcagacttgcatatatttgactgcaagtaccggaattatatatgaataataagcacatacgatggaattactcaaatggagaactgaccaggctactaacaatagagtccagattggaaaagaagcactgtggaataacttgtgagaggattctgtgctaaattagaactttttcaaaggtggcctgaaaagaggggacttcagtttaattccagagatggtaattctggggacgtgttttacttggagctggacttcttgtgacgtggtgatgaagaaagagggaaacctaaacttccttgtccatttttggtgtggatgtctcagagacatcaggttgtagcagtgtctgaaatttgtttcctaagtgtctctgaagtccagcgcttctcttcactgtaaagaactgaggggtgggcagtacagacctgtctgttggtcctgtgttctgagcattgcagaacctcgactgctgacttgggacccccctgggctctgctgtacctgcaaaccagaggcactgctatccaggcctttgccccagctcctcggccctggatggtgctgaaaggggcatcatctgtggggtcggctggctctcatggctgggccgctcaggcatagaggatgcaggtggctgctcacaatctggaatttgctctgtctttctgtagttgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaaccccggaggcttcggaattgccccccactgcctggatgagggcactgtgcggagtatggtcactgaggaattcaatggcagcgattgggagaaggccatgaaagagcacaagaccatcaagaacatgtctaaagagtgagcttctgcctctcctgccctgaaaaggaggaatgattggggccagcaactttgctctccctgccgtgcctcggtggtgctcctgaatgtggctgacctgggctgctggttccgttgactagggtcatcttgatctctgcagtttgctccagctaccagtttctttaggcagctctttgtcctccctctgcccagattttgatgtagtctaattgacatccttctcttcccaacttttgtgtgatcttttaggaaaaaaaataaatatttttaacattaaagcagtcactttggtttatcaaa

SEQ ID NO: 376505 - DNA, 1304 bp, Homo sapiens
gaggagctctgcggccgccaagctgcgcgggcagaagcggtccggggcctccgcggcccccgcggcctccgcggccgctgccttggcacccagcgccacccgcacacggcgctccgctagccaggccgggagcaagagccaggcggtggagaagccgccgtcggagaagccgcggctgaggcgctcgtcgccgcgggcccaggaggagggcccgggggagccgccgccgcctgagctggcgttgctcccgccaccgccgccgccgccgccgactcccgcgaccccgacgtcctcggcgtccaacctggacctgggcgagcagcgggagcgctgggagacgttccagaagcggcagaagcttacctccgagggtgccgccaagctcctgctagacacctttgaataccagggcctggtgaagcacacaggaggctgccactgtggagcagttcgttttgaagtttgggcctcagcagacttgcatatatttgactgcaagtaccggaattatatatgaataataagcacatacgatggaattactcaaatggagaactgaccaggctactaacaatagagtccagattggaaaagaagcactgtggaataacttgtgagaggattctgtgctaaattagaactttttcaaaggtggcctgaaaagaggggacttcagtttaattccagagatgttgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaaccccggaggcttcggaattgccccccactgcctggatgagggcactgtgcggagtatggtcactgaggaattcaatggcagcgattgggagaaggccatgaaagagcacaagaccatcaagaacatgtctaaagagtgagcttctgcctctcctgccctgaaaaggaggaatgattggggccagcaactttgctctccctgccgtgcctcggtggtgctcctgaatgtggctgacctgggctgctggttccgttgactagggtcatcttgatctctgcagtttgctccagctaccagtttctttaggcagctctttgtcctccctctgcccagattttgatgtagtctaattgacatccttctcttcccaacttttgtgtgatcttttaggaaaaaaaataaatatttttaacattaaagcagtcactttggtttatcaaa

SEQ ID NO: 376506 - DNA, 1598 bp, Homo sapiens
gaggagctctgcggccgccaagctgcgcgggcagaagcggtccggggcctccgcggcccccgcggcctccgcggccgctgccttggcacccagcgccacccgccgccgccgactcccgcgaccccgacgtcctcggcgtccaacctggacctgggcgagcagcgggagcgctgggagacgttccagaagcggcagaagcttacctccgagggtgccgccaagctcctgctagacacctttgaataccagggcctggtgaagcacacaggaggctgccactgtggagcagttcgttttgaagtttgggcctcagcagacttgcatatatttgactgcaagtaccggaattatatatgaataataagcacatacgatggaattactcaaatggagaactgaccaggctactaacaatagagtccagattggaaaagaagcactgtggaataacttgtgagaggattctgtgctaaattagaactttttcaaaggtggcctgaaaagaggggacttcagtttaattccagagatggtaattctggggacgtgttttacttggagctggacttcttgtgacgtggtgatgaagaaagagggaaacctaaacttccttgtccatttttggtgtggatgtctcagagacatcaggttgtagcagtgtctgaaatttgtttcctaagtgtctctgaagtccagcgcttctcttcactgtaaagaactgaggggtgggcagtacagacctgtctgttggtcctgtgttctgagcattgcagaacctcgactgctgacttgggacccccctgggctctgctgtacctgcaaaccagaggcactgctatccaggcctttgccccagctcctcggccctggatggtgctgaaaggggcatcatctgtggggtcggctggctctcatggctgggccgctcaggcatagaggatgcaggtggctgctcacaatctggaatttgctctgtctttctgtagttgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaaccccggaggcttcggaattgccccccactgcctggatgagggcactgtgcggagtatggtcactgaggaattcaatggcagcgattgggagaaggccatgaaagagcacaagaccatcaagaacatgtctaaagagtgagcttctgcctctcctgccctgaaaaggaggaatgattggggccagcaactttgctctccctgccgtgcctcggtggtgctcctgaatgtggctgacctgggctgctggttccgttgactagggtcatcttgatctctgcagtttgctccagctaccagtttctttaggcagctctttgtcctccctctgcccagattttgatgtagtctaattgacatccttctcttcccaacttttgtgtgatcttttaggaaaaaaaataaatatttttaacattaaagcagtcactttggtttatcaaa

SEQ ID NO: 376507 - DNA, 1712 bp, Homo sapiens
gaggagctctgcggccgccaagctgcgcgggcagaagcggtccggggcctccgcggcccccgcggcctccgcggccgctgccttggcacccagcgccacccgcacacggcgctccgctagccaggccgggagcaagagccaggcggtggagaagccgccgtcggagaagccgcggctgaggcgctcgtcgccgcgggcccaggaggagggcccgggggagccgccgccgcctgagctggcgttgctcccgccaccgccgccgccgccgccgactcccgcgaccccgacgtcctcggcgtccaacctggacctgggcgagcagcgggagcgctgggagacgttccagaagcggcagaagcttacctccgagggtgccgccaagctcctgctagacacctttgaataccagggcctggtgaagcacacaggaggctgccactgtggagcagttcgttttgaagtttgggcctcagcagacttgcatatatttgactgcaagtaccggaattatatatgaataataagcacatacgatggaattactcaaatggagaactgaccaggctactaacaatagagtccagattggaaaagaagcactgtggaataacttgtgagaggattctgtgctaaattagaactttttcaaaggtggcctgaaaagaggggacttcagtttaattccagagatggtaattctggggacgtgttttacttggagctggacttcttgtgacgtggtgatgaagaaagagggaaacctaaacttccttgtccatttttggtgtggatgtctcagagacatcaggttgtagcagtgtctgaaatttgtttcctaagtgtctctgaagtccagcgcttctcttcactgtaaagaactgaggggtgggcagtacagacctgtctgttggtcctgtgttctgagcattgcagaacctcgactgctgacttgggacccccctgggctctgctgtacctgcaaaccagaggcactgctatccaggcctttgccccagctcctcggccctggatggtgctgaaaggggcatcatctgtggggtcggctggctctcatggctgggccgctcaggcatagaggatgcaggtggctgctcacaatctggaatttgctctgtctttctgtagttgcagcatttgcaagaagaagcagaatagacacttcattgttccagcttctcgcttcaagctcctgaaggtcagtgcttaagagcagggtcaaggagtgcagaacccattggtgagatttacaggaccccccacccaaccgttagcatgccgtctgtagcatgggaggggcctggagcatagcagggcctctcacgggctttggtttcaggttgacatttaaaaggtgggcccggcacagtggctcacgcctgtaatcccagcactttgggaggccaagatggatggatcacctgaagtcaggagttgaggaccagcctggccaacatggtgaaaccctatctctactaaaaatacaaaaattagctgggcgttgtagtgcatgcctgtaatcccagctacttgggaggccaaggcaggagaatcacttgaacctgggaggtggaggttgcagtgagccgagatcacaccattgcactccagcctgggtgacaagagtgaaactccatctcaaaaaaaatgaaaataaaaaataaaaggttgtgttattttttacctttattttt

SEQ ID NO: 376508 - DNA, 313 bp, Homo sapiens
tctaatcttctgtctttctttcagcaacaaaaagagagcaggaggcagctattcagaaattattatctttctgatttttgtttcatttagtgaataccagggcctggtgaagcacacaggaggctgccactgtggagcagttcgttttgaagtttgggcctcagcagacttgcatatatttgactgcaagtgagtatttttttttccctaaattggcttaaaagaatttcagagttaaaatgcaatatttcaaaataatctggggagttggggtacagaggaaacattggccttgggctggtaactgttgaag

SEQ ID NO: 376509 - DNA, 1110 bp, Homo sapiens
gaggagctctgcggccgccaagctgcgcgggcagaagcggtccggggcctccgcggcccccgcggcctccgcggccgctgccttggcacccagcgccacccgcacacggcgctccgctagccaggccgggagcaagagccaggcggtggagaagccgccgtcggagaagccgcggctgaggcgctcgtcgccgcgggcccaggaggagggcccgggggagccgccgccgcctgagctggcgttgctcccgccaccgccgccgccgccgccgactcccgcgaccccgacgtcctcggcgtccaacctggacctgggcgagcagcgggagcgctgggagacgttccagaagcggcagaagcttacctccgagggtgccgccaagctcctgctagacacctttgaataccagggcctggtgaagcacacaggaggctgccactgtggagcagttcgttttgaagtttgggcctcagcagacttgcatatatttgactgcaattgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaaccccggaggcttcggaattgccccccactgcctggatgagggcactgtgcggagtatggtcactgaggaattcaatggcagcgattgggagaaggccatgaaagagcacaagaccatcaagaacatgtctaaagagtgagcttctgcctctcctgccctgaaaaggaggaatgattggggccagcaactttgctctccctgccgtgcctcggtggtgctcctgaatgtggctgacctgggctgctggttccgttgactagggtcatcttgatctctgcagtttgctccagctaccagtttctttaggcagctctttgtcctccctctgcccagattttgatgtagtctaattgacatccttctcttcccaacttttgtgtgatcttttaggaaaaaaaataaatatttttaacattaaagcagtcactttggtttatcaaa

SEQ ID NO: 376510 - DNA, 1773 bp, Homo sapiens
cccgggtgtatatcggacgaggagctgcgcgggcagattgctggtcctggggcggtccggggcctccgcggcccccgcggcctccgcggccgctgccttggcacccagcgccacccgcacacggcgctccgctagccaggccgggagcaagagccaggcggtggagaagccgccgtcggagaagccgcggctgaggcgctcgtcgccgcgggcccaggaggagggcccgggggagccgccgccgcctgagctggcgttgctcccgccaccgccgccgccgccgccgactcccgcgaccccgacgtcctcggcgtccaacctggacctgggcgagcagcgggagcgctgggagacgttccagaagcggcagaagcttacctccgagggtgccgccaagctcctgctagacacctttgaataccagggcctggtgaagcacacaggaggctgccactgtggagcagttcgttttgaagtttgggcctcagcagacttgcatatatttgactgcaagtaccggaattatatatgaataataagcacatacgatggaattactcaaatggagaactgaccaggctactaacaatagagtccagattggaaaagaagcactgtggaataacttgtgagaggattctgtgctaaattagaactttttcaaaggtggcctgaaaagaggggacttcagtttaattccagagatggtaattctggggacgtgttttacttggagctggacttcttgtgacgtggtgatgaagaaagagggaaacctaaacttccttgtccatttttggtgtggatgtctcagagacatcaggttgtagcagtgtctgaaatttgtttcctaagtgtctctgaagtccagcgcttctcttcactgtaaagaactgaggggtgggcagtacagacctgtctgttggtcctgtgttctgagcattgcagaacctcgactgctgacttgggacccccctgggctctgctgtacctgcaaaccagaggcactgctatccaggcctttgccccagctcctcggccctggatggtgctgaaaggggcatcatctgtggggtcggctggctctcatggctgggccgctcaggcatagaggatgcaggtggctgctcacaatctggaatttgctctgtctttctgtagttgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaaccccggaggcttcggaattgccccccactgcctggatgagggcactgtgcggagtatggtcactgaggaattcaatggcagcgattgggagaaggccatgaaagagcacaagaccatcaagaacatgtctaaagagtgagcttctgcctctcctgccctgaaaaggaggaatgattggggccagcaactttgctctccctgccgtgcctcggtggtgctcctgaatgtggctgacctgggctgctggttccgttgactagggtcatcttgatctctgcagtttgctccagctaccagtttctttaggcagctctttgtcctccctctgcccagattttgatgtagtctaattgacatccttctcttcccaacttttgtgtgatcttttaggaaaaaaaataaatatttttaacattaaagcagtcactttggtttatcaaa

SEQ ID NO: 376511 - DNA, 1634 bp, Homo sapiens
gaggagctctgcggccgccaagctgcgcgggcagaagcggtccggggcctccgcggcccccgcggcctccgcggccgctgccttggcacccagcgccacccgcacacggcgctccgctagccaggccgggagcaagagccaggcggtggagaagccgccgtcggagaagccgcggctgaggcgctcgtcgccgcgggcccaggaggagggcccgggggagccgccgccgcctgagctggcgttgctcccgccaccgccgccgccgccgccgactcccgcgaccccgacgtcctcggcgtccaacctggacctgggcgagcagcgggagcgctgggagacgttccagaagcggcagaagcttacctccgagggtgccgccaagctcctgctagacacctttgaataccagggcctggtgaagcacacaggaggctgccactgtggagcagttcgttttgaagtttgggcctcagcagacttgcatatatttgactgcaagtaccggaattatatatgaataataagcacatacgatggaattactcaaatggagaactgaccaggctactaacaatagagtccagattggaaaagaagcactgtggaataacttgtgagaggattctgtgctaaattagaactttttcaaaggtggcctgaaaagaggggacttcagtttaattccagagatggtaattctggggacgtgttttacttggagctggacttcttgtgacgtggtgatgaagaaagagggaaacctaaacttccttgtccatttttggtgtggatgtctcagagacatcaggttgtagcagtgtctgaaatttgtttcctaagtgtctctgaagtccagcgcttctcttcactgtaaagaactgaggggtgggcagtacagacctgtctgttggtcctgtgttctgagcattgcagaacctcgactgctgacttgggacccccctgggctctgctgtacctgcaaaccagaggcactgctatccaggcctttgccccagctcctcggccctggatggtgctgaaaggggcatcatctgtggggtcggctggctctcatggctgggccgctcaggcatagaggatgcaggtggctgctcacaatctggaatttgctctgtctttctgtagttgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaaccccggaggcttcggaattgccccccactgcctggatgagggcactgtgcggagtatggtcactgaggaattcaatggcagcgattgggagaagtcctgaatgtggctgacctgggctgctggttccgttgactagggtcatcttgatctctgcagtttgctccagctaccagtttctttaggcagctctttgtcctccctctgcccagattttgatgtagtctaattgacatccttctcttcccaacttttgtgtgatcttttaggaaaaaaaataaatatttttaacattaaagcagtcactttggtttatcaaa

SEQ ID NO: 376512 - DNA, 1412 bp, Homo sapiens
cgactgccgccccgagtgtccgcagcgctcgtgctgcagctccgcacctgcggccagtgcctactgccctctcttgccgcccgcacctgcagccccgcacctgccgcttgcacctgcagccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccaaggactttgaccctgccgtcactgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaaaact

SEQ ID NO: 376513 - DNA, 1442 bp, Homo sapiens
gattcacccgccggcgcctggcctggcccagttgcaccacgagcgctgcggacactcggggcggcagtcggtctgtcagtcctcccgccaggtcccgcggcccgcacctgccgcccgcacctgcagctccgcacctgcggccagtgcctactgccctctcttgccgcccgcacctgcagccccgcacctgccgcttgcacctgcagccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccaaggactttgaccctgccgtcactgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaaaact

SEQ ID NO: 376514 - DNA, 1194 bp, Homo sapiens
cacatcttggaaattcaaatactcaatagctctcgaattctaggaatcttgagaagaggcctggattaaggattcagacgtgggccctcagatggctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccaaggactttgaccctgccgtcactgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaaaact

SEQ ID NO: 376515 - DNA, 1089 bp, Homo sapiens
tggaaattcctggagtctccttcctggcattctccgagattgccacccagccaggccagcccttcagagacgtggtcacaaccctggggcctgctcttttctggcagagtggccccaggttcttcatctgggcctcctaggctctgccaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccaaggactttgaccctgccgtcactgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaaaact

SEQ ID NO: 376516 - DNA, 1095 bp, Homo sapiens
catctcgaacgtcactgggcacaggaatcatttggggatcttgctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccaaggactttgaccctgccgtcactgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaaaact

SEQ ID NO: 376517 - DNA, 1443 bp, Homo sapiens
gattcacccgccggcgcctggcctggcccagttgcaccacgagcgctgcggacactcggggcggcagtcggtctgtcagtcctcccgccaggtcccgcggcccgcacctgccgcccgcacctgcagctccgcacctgcggccagtgcctactgccctctcttgccgcccgcacctgcagccccgcacctgccgcttgcacctgcagccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccaaggactttgaccctgccgtcactgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcacttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaaaact

SEQ ID NO: 376518 - DNA, 1499 bp, Homo sapiens
gattcacccgccggcgcctggcctggcccagttgcaccacgagcgctgcggacactcggggcggcagtcggtctgtcagtcctcccgccaggtcccgcggcccgcacctgccgcccgcacctgcagctccgcacctgcggccagtgcctactgccctctcttgccgcccgcacctgcagccccgcacctgccgcttgcacctgcagccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccaaggactttgaccctgccgtcactgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaaaact

SEQ ID NO: 376519 - DNA, 1095 bp, Homo sapiens
cgagaggatcccgcgctacaacgccaaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgccaaggactttgaccctgccgtcactgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaaaact

SEQ ID NO: 376520 - DNA, 1444 bp, Homo sapiens
gattcacccgccggcgcctggcctggcccagttgcaccacgagcgctgcggacactcggggcggcagtcggtctgtcagtcctcccgccaggtcccgcggcccgcacctgccgcccgcacctgcagctccgcacctgcggccagtgcctactgccctctcttgccgcccgcacctgcagccccgcacctgccgcttgcacctgcagccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaagtgagtacatccagaggaagaagttccccccagataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaaaact

SEQ ID NO: 376521 - DNA, 893 bp, Homo sapiens
ggtaacaaactttctcagcctttaaggtgttactaaatggtacagtttctgtaatgcctgcctcagccccataaccagaatcaaccataccctcgttggggcttctgtgggcaatctgacctattgtgagatgatgagaggctgtctccatttttccattttctatttattgggaacaggattctcatcacattttttagcacagccccaaatacataccttgtaggtgctcggtgaatggatgtggaatcaaagaaacttaggagacaccaagaaaactctctttcttattttctgcaatcctaattcttgctggtcttaacttgcaggataattcagctccttatggggcccggtatgtgggctccatggtggctgatgttcatcgcactctggtctacggagggatatttctgtaccccgctaacaagaagagccccaatggaaagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaaaact

SEQ ID NO: 376522 - DNA, 1679 bp, Homo sapiens
caaattattaaaaccacaatgagataccccttcacacatgccagaatggtgatgataaaaagacagacaataacagacattagaaaggatgtggagaaattgggtccttcataaaccactggtggaagtggaaaagagtgcagccaccttggaaaagaatttggcagttatcacatgttaaatacagcattaccctatggcccagcaaattccactcctaggtgtatacccaagaagaatgaagacataggtctgcacaataatttgtacatccatgtccgtagcagcattactcataatagccaaaaagtggaaacaacttaaatgcccaccaactgatgaatgcataagcaagatctggtatatccatacagatctattattgggtagtaacaagaatggggtagtaacaagaatgaagtactgacacatgatacaacatggatgaacttcaaaagtaaaggacgccatgcaccaagtgtcattcttggaaacgtgggagatttaggaaatgacattgaagaggaagaattctgttgaaatagtgattctcaacgtggggtccttggacagcaaggatgaggaaaaaacacagtcatccaaggagccagaagttatatgctgacaaaatgccaccgactactttagtggaagctgttgttgggatagggaatctgcaccctctagagaagcagggacttcagctgctgaggaagggctgtcagagttatccatgttattttttttcatttttgtgagtacggtgcctcctaaacaatcacatgaggatttgagactgttagaactcagtgttgttatccacacaaacggaaacattcattatttttaaaaaatgattgaaaatatcagatgaagtaaaaaattgacattaactgtattatagaaatgggaaagtatatccttttgtaatataagatgtattagaagcaaagaagggaaatgggcttcaaacaaaaataaataaatgtaaagatcagtttaattctgaagttaagtggcattttttcccctttctttccaaaataccgagctaaggttttcttgattgtgtttgactctctgcatctcaggagtgatggggattggaattcctgtccccaggttttctttgtatagcacctgtatgatgagaaagcatccagaacaaaaaaagcaatcaatcagtcattttccccctgctttggagcagttgggagtgggaagggaggaagagagtaagttagaggaagagaaatacagaagcttttagactcaacctgtttgtttgagcctaaagacatcttcaaaagcaaaggaatgcaggaaagagcagcaaaaactaagaaataggaaaagaaaggttgttattttcattgtttgaactaatctctgcagcactgagcaaccgtgaaagagcaattagtcttttcccaccttgttacaaggagggaaaaaagtagaaacagacaagaaaccaaggaagttacttttgatttgaaaatgctgttaatcacatagggatatttgggttttacaaacattgtgtatatggagacacatacacacaactcttcttttgttcactttcaaaagaagtcagagtatttaatttttagtttgggtgaacacattgagaacaacgatgtttaaggcaaatggagagcaatgataaggtgcta

SEQ ID NO: 376523 - DNA, 531 bp, Homo sapiens
gtaccgagctaatattttcttgattgtgtttgactctttccatctcgggagtgacaggtaaaggggttcccttgcccatgttttctttgtataacacctgtgcgataagaaagcatccagaaaaacaaccatgagtaacatttcatttcttgggactttttaaggatgaggaaaaaacacagtcatccaaggagccagaagttatatgctgacaaaatgccaccgactactttagtggaagctgttgttgggatagggaatctgcaccctctagagaagcagggacttcagctgctgaggaagggctgtcagagttatccatgttattttttttcatttttgtgagtacggtgcctcctaaacaatcacatgaggatttgagactgttagaactcagtgttgttatccacacaaacggaaacattcattatttttaaaaaatgattgaaaatatcagatgaagtaaaaaattgacattaactgtattatagaaatgggaatggtgttaggctagaagtagcccaaaggaaa

SEQ ID NO: 376524 - DNA, 885 bp, Homo sapiens
atataagatgtattagaagcaaagaagggaaatgggcttcatacaaaaataaataaatgtaaagatcagtttaattatgaagtaaaaaattgacattaactgtattatagaaatgggaaagtatatccttttgtaatataagatgtattagaagcaaagaagggaaatgggcttcaaacaaaaataaataaatgtaaagatcagtttaattctgaagttaagtggcattttttcccctttctttccaaaataccgagctaaggttttcttgattgtgtttgactctctgcatctcaggagtgatggggattggaattcctgtccccaggttttctttgtatagcacctgtatgatgagaaagcatccagaacaaaaaaagcaatcaatcagtcattttccccctgctttggagcagttgggagtgggaagggaggaagagagtaagttagaggaagagaaatacagaagcttttagactcaacctgtttgtttgagcctaaagacatcttcaaaagcaaaggaatgcaggaaagagcagcaaaaactaagaaataggaaaagaaaggttgttattttcattgtttgaactaatctctgcagcactgagcaaccgtgaaagagcaattagtcttttcccaccttgttacaaggagggaaaaaagtagaaacagacaagaaaccaaggaagttacttttgatttgaaaatgctgttaatcacatagggatatttgggttttacaaacattgtgtatatggagacacatacacacaactcttcttttgttcactttcaaaagaagtcagagtatttaatttttagtttgggtgaacacattgagaacaacgatgtttaaggcaaatggagagcaatgataaggtgcta

SEQ ID NO: 376525 - DNA, 533 bp, Homo sapiens
ttcgttttttaggtatccagtataattgattcattagaaatactgtttaacaaaggagagacgcattctgctgttgttgattttgaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactgtgagtgttcttttatgtaagaattttctggatactgcatcggaaggttctgcactaagcttaaaattcagtctggtggccaggtacggtggctctcacctgtagtcccaaatgttgggatgacaggcgtgagccaccacacccagcccctaaaacctgggattttacttgcttaaaatgcagaagacttcgtggtaatgttcagtatgacacagtaactcgagtgtctcataaat

SEQ ID NO: 376526 - DNA, 9174 bp, Homo sapiens
accagaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgtgggtccagaagccttgagttttgctaagcaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaattatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagcataataccacttcagccaaaggatttctgtccccaggatcacgtagccctaaatttaagagctcaaagaagtgtttaatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttgtggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatccttcctttctccaaagaacagttaaaaccaaatgtgttatggtaagctgtaaataccgttggaataaaagataaccgttcatcttacctaaaaaattgaagacaatattttccattgttgatgtcacaagtaagaaaaaaactctaacttttgtactctacttgtagcagagggaatatttttggccacagtgtgccaatttataattgtagataaagctgaatttactgggcagcaagcttatatgctgatagaagttgatgcactgagaagtgatgagttgaagagaatggaaaaggcagattgagctggaattttaatgcatagtacatttagtagagagacaagctgtcctatatactcctgtatacttcagaaatagctgatagcctatagtctctgagagctattctgtacatagcacagtattataattgatgttcataaataccctgagagattatgttaaaatacattattaatactcccacaaaagcagtaagttaataagtatttccaacaaaaggcagctttgtttcttaaacggataaacaacatataactaggaagatcatcttcaaaataaagtgtcatggaactgaaaatagagtatagtctaacaattattttgatacactattgaatagctaacaagtgtctaaagaattttttatttttatagaataggaagtttctaaaagaaaacaattaagagcaaaattggttttgagtatagaaactgaaggatggcagtcttaactcctaagttttttacagagcacagattggtaaactagcatgccacctgttttttgtactatctgtgagctgagactggtttttacattttttaatggtgaaaaaagtcaaaagaaggaggacattttgtgacacatgaaaacatattaaattaaaatttcagtatccagaaataaagttttattggaacagctgtgcttattgtctttagctgctttcctggtacagtggctgagtttagtagtatagcagagtctgtatggcttccaacagtcaaaatactgcctggccttttaaagagtttgtcaatcccttttatggaggaaggttttgctcatgcatggcatgttagtcaatttagttatttgcttctagctggcagaatgtggtcttgattacttaatttctgttacccctgtgttttccagaatggcttctcctgattttacttacgtgttttactattgctcaaattacagatactaggaaacactactactttataagtacacttctttttcctacttaaactctcaaactacagttacgtatttgccatgatgttaagggaccttgatggtctgtgaattatcagttgctttctgcactacctcctgtagatagacctgactgatagcacttacaaaaagactgatagatgccaaatcagtcatttattaaccctctaatattgttgtcccgatcatttggtaaacgctaagagagcttagttttacattcacaaagtatttgtatttgataagtcttaaaaatgatttaagttgaagcctaacagaagtacttgttcattcctcagttacctgcaaataatggaaataatggtgcagtcagttttatttgattgtgtaatgctttatactaggggtctcaaacccctgggtggcattagattcttacaggagcgtgaaccctattgtgaactgcacatgcaagagatctaggttgtgcgctcattatgagaatctaatacccgatgatctgaggtggaacagtctcatcctgaaaccatctaccccaacacctgtgtctgtggaaattgtctccacgaaaccggtccctgttgaaaaaaggttaggggaccactgctttatacagtgtttgaagtaggcacacttacagttactatttctggttctttatgactgttgaggggggcagaattctatgtttgattcacagtaaaacttttcatgaatcattgagggttaactgttatcacttgccaatggaaactggatattgaaacatttttttaagaaatgcacttttacctgaaataaaactataaaaactaaaaaaaaata

SEQ ID NO: 376527 - DNA, 9096 bp, Homo sapiens
accagaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgtgggtccagaagccttgagttttgctaagcaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaattatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttgtggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatccttcctttctccaaagaacagttaaaaccaaatgtgttatggtaagctgtaaataccgttggaataaaagataaccgttcatcttacctaaaaaattgaagacaatattttccattgttgatgtcacaagtaagaaaaaaactctaacttttgtactctacttgtagcagagggaatatttttggccacagtgtgccaatttataattgtagataaagctgaatttactgggcagcaagcttatatgctgatagaagttgatgcactgagaagtgatgagttgaagagaatggaaaaggcagattgagctggaattttaatgcatagtacatttagtagagagacaagctgtcctatatactcctgtatacttcagaaatagctgatagcctatagtctctgagagctattctgtacatagcacagtattataattgatgttcataaataccctgagagattatgttaaaatacattattaatactcccacaaaagcagtaagttaataagtatttccaacaaaaggcagctttgtttcttaaacggataaacaacatataactaggaagatcatcttcaaaataaagtgtcatggaactgaaaatagagtatagtctaacaattattttgatacactattgaatagctaacaagtgtctaaagaattttttatttttatagaataggaagtttctaaaagaaaacaattaagagcaaaattggttttgagtatagaaactgaaggatggcagtcttaactcctaagttttttacagagcacagattggtaaactagcatgccacctgttttttgtactatctgtgagctgagactggtttttacattttttaatggtgaaaaaagtcaaaagaaggaggacattttgtgacacatgaaaacatattaaattaaaatttcagtatccagaaataaagttttattggaacagctgtgcttattgtctttagctgctttcctggtacagtggctgagtttagtagtatagcagagtctgtatggcttccaacagtcaaaatactgcctggccttttaaagagtttgtcaatcccttttatggaggaaggttttgctcatgcatggcatgttagtcaatttagttatttgcttctagctggcagaatgtggtcttgattacttaatttctgttacccctgtgttttccagaatggcttctcctgattttacttacgtgttttactattgctcaaattacagatactaggaaacactactactttataagtacacttctttttcctacttaaactctcaaactacagttacgtatttgccatgatgttaagggaccttgatggtctgtgaattatcagttgctttctgcactacctcctgtagatagacctgactgatagcacttacaaaaagactgatagatgccaaatcagtcatttattaaccctctaatattgttgtcccgatcatttggtaaacgctaagagagcttagttttacattcacaaagtatttgtatttgataagtcttaaaaatgatttaagttgaagcctaacagaagtacttgttcattcctcagttacctgcaaataatggaaataatggtgcagtcagttttatttgattgtgtaatgctttatactaggggtctcaaacccctgggtggcattagattcttacaggagcgtgaaccctattgtgaactgcacatgcaagagatctaggttgtgcgctcattatgagaatctaatacccgatgatctgaggtggaacagtctcatcctgaaaccatctaccccaacacctgtgtctgtggaaattgtctccacgaaaccggtccctgttgaaaaaaggttaggggaccactgctttatacagtgtttgaagtaggcacacttacagttactatttctggttctttatgactgttgaggggggcagaattctatgtttgattcacagtaaaacttttcatgaatcattgagggttaactgttatcacttgccaatggaaactggatattgaaacatttttttaagaaatgcacttttacctgaaataaaactataaaaactaaaaaaaaata

SEQ ID NO: 376528 - DNA, 8707 bp, Homo sapiens
accagaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgtgggtccagaagccttgagttttgctaagcaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaattatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttgtggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgcatattctggtgaaacatgtaaaatactttaagtaaaattgaacatttttatttgaatttttgctgaactgataaaggtgtttatatttttgtttgtttgtttgtttaattcatgtttgttgggactgaggtttaggaagtttgttactggttaaaaacctcaaatgaaatgcgaaagaatttgaatttttcctgcatatgtcaactttggacagctttcaagaaaaatgagaaaagtttcaacttctggcggttaaaatattaatgcagaatttactaagattttattcatttgcattagcaaatattcatgcagcagcagttgactgaaaatttattcttatgagacgtatagtattcatttttaaatgcatgattgtacattatgtatagacgacaatgtttttaatttataaatttcattctttgttaattgcatgggtttttctgcagcttattgtgaataccttggttctgttcaatagaaacattttgtatatattaaatactgaaatatcagtatcgacggtggaagtgcttcatgggcttgctgcacatatttgtaggatactgtatctgcaaatgcaacaacaaatagttttgtacttggttaacagtcttagttaaaacatgagtttattttctaaaagtatccagaataagtaaaattatagaaataagaaaatgttacacaactttgctgttcatacccttaccttcttactacttttggtttggaggagggtatcaccactagaaagtgtgcctccttaagatttcttaaaggaaagttagtttcagtatttcacagcaagttggactacaaaatctagagttgatctgctttttaaaccttcatttaaaagcaaacttggaagaaatttgaaactgatgtttttaatatatgtctgtgttgcctaggttttctttttttaaagaggtatgtaattaaaacctttgtaaaatttgccaactaatattagtgcctgacttcccatatttgtttcatctttttaactgacagtatatctcacttcttctttgaatagaatgagtgagtgatctcagttttcacattttattcagaagctaatccctacttagcaaggcacacattctacagcaagtcatagaaagtttaatccttgtgcctccttagctctcgtatattcagggatctctataaaagttggtgtcttttttcatcatcataaattcatcataatcacagatatttttgggtctaagatattcatataccaaggatggttttgtaaagaattctgggatcattgaattaaggattgtggcttgaagtaactaaagaaaaatactaatttccttaaaaggaattataattatgatttacattttacatcattaatttcccaaattatatttaaccgtaaggaggtgcacatgagtttttagcaaacaggtatgaataagcagctatgtatatgtgtttggggcagaggggagcagattactttaacacacttcagaattaaaatcagttcgtttcatga

SEQ ID NO: 376529 - DNA, 8251 bp, Homo sapiens
accagaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgtgggtccagaagccttgagttttgctaagcaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaattatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagcataataccacttcagccaaaggatttctgtccccaggatcacgtagccctaaatttaagagctcaaagaagtgtttaatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttgtggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatccttcctttctccaaagaacagttaaaaccaaatgtgttatggtaagctgtaaataccgttggaataaaagataaccgttcatcttacctaaaaaattgaagacaatattttccattgttgatgtcacaatttcttgaagatggctctttgcagcctacgtggtagtggagatatatacaaaggacttccctagtatcgttggaccaacaagcacaagcagatggcaggaagattagaacattggatattgattgccagtttttaagtgtcattcttggaaacgtgggagatttaggaaatgacattgaagaggaagaattctgttgaaatagtgattctcaacgtggggtccttggacagcaagtgatggggattggaatcccttttccaacgttttctttatacaacacctgtatgacacaagaaagcatccagaaaaaacaagagcagtcaaaacagccctttcatctaccttgtggggaacctggtataaaactacagacgtcagacagaaaagacagattcaacaagtcaacctctctgttcaggcacagatctggttttaatgatgaactctacaatgctaattctggaaatgaaaaagtacaatggaaagcattaagttatataacgctgaggaatcttgttaattctacttatagtatttcaaatctagtcaagtcactgaaaatgttcaagtataatcggaaatgtgtctttccgatagccgttcctggtgagacatcctctttatataaaacctgggcattcagaatcaggacagtgttaacacagaagaaaagaaaacccagcagttcctggagaaagactaggacacatggcttttgtgaaaacaagacactagacgatgttcccaggggttttcgccatgaaccttgccatgggtgaggaaaagatactatattttctccccaataccaccaacgaagtaacagatgagtctttcatgctgtgatttgggattaagatacaaggtgagcccagagatgaattgggcacacatttcctggggcaggatgggagttgtggagggctgcacaacagccccactgcaagcctgggatatccagaggcatcttcctcagcacccctaggtgcctgtgggctgtgccttacatttaataaaaacttacaaggctg

SEQ ID NO: 376530 - DNA, 9168 bp, Homo sapiens
accagaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgtgggtccagaagccttgagttttgctaagcaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaattatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagcataataccacttcagccaaaggatttctgtccccaggatcacgtagccctaaatttaagagctcaaagaagtgtttaatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttgtggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgcatattctggtgaaacatgtaaaatactttaagtaaaattgaacatttttatttgaatttttgctgaactgataaaggtgtttatatttttgtttgtttgtttgtttaattcatgtttgttgggactgaggtttaggaagtttgttactggttaaaaacctcaaatgaaatgcgaaagaatttgaatttttcctgcatatgtcaactttggacagctttcaagaaaaatgagaaaagtttcaacttctggcggttaaaatattaatgcagaatttactaagattttattcatttgcattagcaaatattcatgcagcagcagttgactgaaaatttattcttatgagacgtatagtattcatttttaaatgcatgattgtacattatgtatagacgacaatgtttttaatttataaatttcattctttgttaattgcatgggtttttctgcagcttattgtgaataccttggttctgttcaatagaaacattttgtatatattaaatactgaaatatcagtatcgacggtggaagtgcttcatgggcttgctgcacatatttgtaggatactgtatctgcaaatgcaacaacaaatagttttgtacttggttaacagtcttagttaaaacatgagtttattttctaaaagtatccagaataagtaaaattatagaaataagaaaatgttacacaactttgctgttcatacccttaccttcttactacttttggtttggaggagggtatcaccactagaaagtgtgcctccttaagatttcttaaaggaaagttagtttcagtatttcacagcaagttggactacaaaatctagagttgatctgctttttaaaccttcatttaaaagcaaacttggaagaaatttgaaactgatgtttttaatatatgtctgtgttgcctaggttttctttttttaaagaggtatgtaattaaaacctttgtaaaatttgccaactaatattagtgcctgacttcccatatttgtttcatctttttaactgacagtatatctcacttcttctttgaatagaatgagtgagtgatctcagttttcacattttattcagaagctaatccctacttagcaaggcacacattctacagcaagtcatagaaagtttaatccttgtgcctccttagctctcgtatattcagggatctctataaaagttggtgtcttttttcatcatcataaattcatcataatcacagatatttttgggtctaagatattcatataccaaggatggttttgtaaagaattctgggatcattgaattaaggattgtggcttgaagtaactaaagaaaaatactaatttccttaaaaggaattataattatgatttacattttacatcattaatttcccaaattatatttaaccgtaaggaggtgcacatgagtttttagcaaacaggtatgaataagcagctatgtatatgtgtttggggcagaggggagcagattactttaacacacttcagaattaaaatcagttcgtttcatgactctgtgccttaacgtttgtgtgaactaaacttgctgattgaatgaaattcttgggaagccgaacagtaatagcagaaaatgtgaccaaatgagtatcatgtacttaaatcactgaattttatataagcacaagtattaattttaaaaacattatagtttaataaagctgcatttaaaaatatttgggagcaaagacaagcatgctaaatcttcattttgctatggctataagcatatatttttggcaacttatttgcaatattcttgccttaaagtttcctgcaaatttcccccttagtaattcccgaatagcaaaacattaatattccatgattagctctattgtgttgtctcactattaaaatggaattcgttttttcaaatcttttctaatggttaataaaacaaatgtcagatcataataacactcaaatgt

SEQ ID NO: 376531 - DNA, 8192 bp, Homo sapiens
ccaggatggtctcgatctcctgacctcgtgatccacccgcctcggcctcccaaagtgctggcattacaggagtgagccactgcgcccggccaagagcttgatttttgtgtgcagtatatggaaataattttactaacatggttgtcataccctaagtaatgccaaaagttaaatttgtcatgctaaaacaattttatttcttaaataaccaattataaaaaacaaatgttctattctttgtaactgagaagattgacttcattttctccttcagggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaattatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagcataataccacttcagccaaaggatttctgtccccaggatcacgtagccctaaatttaagagctcaaagaagtgtttaatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttgtggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatccttcctttctccaaagaacagttaaaaccaaatgtgttatggtaagctgtaaataccgttggaataaaagataaccgttcatcttacctaaaaaattgaagacaatattttccattgttgatgtcacaagtaagaaaaaaactctaacttttgtactctacttgtagcagagggaatatttttggccacagtgtgccaatttataattgtagataaagctgaatttactgggcagcaagcttatatgctgatagaagttgatgcactgagaagtgatgagttgaagagaatggaaaaggcagattgagctggaattttaatgcatagtacatttagtagagagacaagctgtcctatatactcctgtatacttcagaaatagctgatagcctatagtctctgagagctattctgtacatagcacagtattataattgatgttcataaataccctgagagattatgttaaaatacattattaatactcccacaaaagcagtaagttaataagtatttccaacaaaaggcagctttgtttcttaaacggataaacaacatataactaggaagatcatcttcaaaataaagtgtcatggaactgaaaatagagtatagtctaacaattattttgatacactattgaatagctaacaagtgtctaaagaattttttatttttatagaataggaagtttctaaaagaaaacaattaagagcaaaattggttttgagtatagaaactgaaggatggcagtcttaactcctaagttttttacagagcacagattggtaaactagcatgccacctgttttttgtactatctgtgagctgagactggtttttacattttttaatggtgaaaaaagtcaaaagaaggaggacattttgtgacacatgaaaacatattaaattaaaatttcagtatccagaaataaagttttattggaacagctgtgcttattgtctttagctgctttcctggtacagtggctgagtttagtagtatagcagagtctgtatggcttccaacagtcaaaatactgcctggccttttaaagagtttgtcaatcccttttatggaggaaggttttgctcatgcatggcatgttagtcaatttagttatttgcttctagctggcagaatgtggtcttgattacttaatttctgttacccctgtgttttccagaatggcttctcctgattttacttacgtgttttactattgctcaaattacagatactaggaaacactactactttataagtacacttctttttcctacttaaactctcaaactacagttacgtatttgccatgatgttaagggaccttgatggtctgtgaattatcagttgctttctgcactacctcctgtagatagacctgactgatagcacttacaaaaagactgatagatgccaaatcagtcatttattaaccctctaatattgttgtcccgatcatttggtaaacgctaagagagcttagttttacattcacaaagtatttgtatttgataagtcttaaaaatgatttaagttgaagcctaacagaagtacttgttcattcctcagttacctgcaaataatggaaataatggtgcagtcagttttatttgattgtgtaatgctttatactaggggtctcaaacccctgggtggcattagattcttacaggagcgtgaaccctattgtgaactgcacatgcaagagatctaggttgtgcgctcattatgagaatctaatacccgatgatctgaggtggaacagtctcatcctgaaaccatctaccccaacacctgtgtctgtggaaattgtctccacgaaaccggtccctgttgaaaaaaggttaggggaccactgctttatacagtgtttgaagtaggcacacttacagttactatttctggttctttatgactgttgaggggggcagaattctatgtttgattcacagtaaaacttttcatgaatcattgagggttaactgttatcacttgccaatggaaactggatattgaaacatttttttaagaaatgcacttttacctgaaataaaactataaaaactaaaaaaaaata

SEQ ID NO: 376532 - DNA, 2577 bp, Homo sapiens
cggacctctggtcacttaattttctgttatattatgtggttgaaaattcctgtttcatcgtaaagtgaaatttgaaagatggagttgaataatatgattctcgaaaagtgagtttttcttggaattctgttaaggtgttagattttcctcacatatttaaataatctgtaagaactaccctgaaagcactaaggaaaatgtagccgaaagttaagtaataggttttaaaaatttatcaaaatttattgatagtttgatctgtaaaacaaattgggtttcgtgctttctgatgtccagttaataagtatattatgtgccaggctttacatattgctctttgcaagtagccgttaaagtgtaagtcattgaagtttgaagatctataaatatttaatatagtagtctaaacagttgtgagaatttactcagttctgaaatagaatgttaaattttccgatgtggtcctaatcatttttttctttacatactaagccttcctttctccaaagaacagttaaaaccaaatgtgttatggtaagctgtaaataccgttggaataaaagataaccgttcatcttacctaaaaaattgaagacaatattttccattgttgatgtcacaagtaagaaaaaaactctaacttttgtactctacttgtagcagagggaatatttttggccacagtgtgccaatttataattgtagataaagctgaatttactgggcagcaagcttatatgctgatagaagttgatgcactgagaagtgatgagttgaagagaatggaaaaggcagattgagctggaattttaatgcatagtacatttagtagagagacaagctgtcctatatactcctgtatacttcagaaatagctgatagcctatagtctctgagagctattctgtacatagcacagtattataattgatgttcataaataccctgagagattatgttaaaatacattattaatactcccacaaaagcagtaagttaataagtatttccaacaaaaggcagctttgtttcttaaacggataaacaacatataactaggaagatcatcttcaaaataaagtgtcatggaactgaaaatagagtatagtctaacaattattttgatacactattgaatagctaacaagtgtctaaagaattttttatttttatagaataggaagtttctaaaagaaaacaattaagagcaaaattggttttgagtatagaaactgaaggatggcagtcttaactcctaagttttttacagagcacagattggtaaactagcatgccacctgttttttgtactatctgtgagctgagactggtttttacattttttaatggtgaaaaaagtcaaaagaaggaggacattttgtgacacatgaaaacatattaaattaaaatttcagtatccagaaataaagttttattggaacagctgtgcttattgtctttagctgctttcctggtacagtggctgagtttagtagtatagcagagtctgtatggcttccaacagtcaaaatactgcctggccttttaaagagtttgtcaatcccttttatggaggaaggttttgctcatgcatggcatgttagtcaatttagttatttgcttctagctggcagaatgtggtcttgattacttaatttctgttacccctgtgttttccagaatggcttctcctgattttacttacgtgttttactattgctcaaattacagatactaggaaacactactactttataagtacacttctttttcctacttaaactctcaaactacagttacgtatttgccatgatgttaagggaccttgatggtctgtgaattatcagttgctttctgcactacctcctgtagatagacctgactgatagcacttacaaaaagactgatagatgccaaatcagtcatttattaaccctctaatattgttgtcccgatcatttggtaaacgctaagagagcttagttttacattcacaaagtatttgtatttgataagtcttaaaaatgatttaagttgaagcctaacagaagtacttgttcattcctcagttacctgcaaataatggaaataatggtgcagtcagttttatttgattgtgtaatgctttatactaggggtctcaaacccctgggtggcattagattcttacaggagcgtgaaccctattgtgaactgcacatgcaagagatctaggttgtgcgctcattatgagaatctaatacccgatgatctgaggtggaacagtctcatcctgaaaccatctaccccaacacctgtgtctgtggaaattgtctccacgaaaccggtccctgttgaaaaaaggttaggggaccactgctttatacagtgtttgaagtaggcacacttacagttactatttctggttctttatgactgttgaggggggcagaattctatgtttgattcacagtaaaacttttcatgaatcattgagggttaactgttatcacttgccaatggaaactggatattgaaacatttttttaagaaatgcacttttacctgaaataaaactataaaaactaaaaaaaaata

SEQ ID NO: 376533 - DNA, 1772 bp, Homo sapiens
tgggcggacgcgtgggttcatgcagcagcagttgactgaatatttgctaatgcaaatgaataaaatcttagtaaattctgcattaagattttattcatttgcattagcaaatattcatgcagcagcagttgactgaaaatttattcttatgagacgtatagtattcatttttaaatgcatgattgtacattatgtatagacgacaatgtttttaatttataaatttcattctttgttaattgcatgggtttttctgcagcttattgtgaataccttggttctgttcaatagaaacattttgtatatattaaatactgaaatatcagtatcgacggtggaagtgcttcatgggcttgctgcacatatttgtaggatactgtatctgcaaatgcaacaacaaatagttttgtacttggttaacagtcttagttaaaacatgagtttattttctaaaagtatccagaataagtaaaattatagaaataagaaaatgttacacaactttgctgttcatacccttaccttcttactacttttggtttggaggagggtatcaccactagaaagtgtgcctccttaagatttcttaaaggaaagttagtttcagtatttcacagcaagttggactacaaaatctagagttgatctgctttttaaaccttcatttaaaagcaaacttggaagaaatttgaaactgatgtttttaatatatgtctgtgttgcctaggttttctttttttaaagaggtatgtaattaaaacctttgtaaaatttgccaactaatattagtgcctgacttcccatatttgtttcatctttttaactgacagtatatctcacttcttctttgaatagaatgagtgagtgatctcagttttcacattttattcagaagctaatccctacttagcaaggcacacattctacagcaagtcatagaaagtttaatccttgtgcctccttagctctcgtatattcagggatctctataaaagttggtgtcttttttcatcatcataaattcatcataatcacagatatttttgggtctaagatattcatataccaaggatggttttgtaaagaattctgggatcattgaattaaggattgtggcttgaagtaactaaagaaaaatactaatttccttaaaaggaattataattatgatttacattttacatcattaatttcccaaattatatttaaccgtaaggaggtgcacatgagtttttagcaaacaggtatgaataagcagctatgtatatgtgtttggggcagaggggagcagattactttaacacacttcagaattaaaatcagttcgtttcatgactctgtgccttaacgtttgtgtgaactaaacttgctgattgaatgaaattcttgggaagccgaacagtaatagcagaaaatgtgaccaaatgagtatcatgtacttaaatcactgaattttatataagcacaagtattaattttaaaaacattatagtttaataaagctgcatttaaaaatatttgggagcaaagacaagcatgctaaatcttcattttgctatggctataagcatatatttttggcaacttatttgcaatattcttgccttaaagtttcctgcaaatttcccccttagtaattcccgaatagcaaaacattaatattccatgattagctctattgtgttgtctcactattaaaatggaattcgttttttcaaatcttttctaatggttaataaaacaaatgtcagatcataataacactcaaatgt

SEQ ID NO: 376534 - DNA, 1010 bp, Homo sapiens
accagaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgtgggtccagaagccttgagttttgctaagcaaataaacttgtgctgagcttagaaaaaaaaaaaaaaatgttggggggtggccacagaaatttaaaccactcgtggggggccgtggtaggacggctcacgtccaggaccggtcgcgaggggttccacacaaaagcgggg

SEQ ID NO: 376535 - DNA, 1289 bp, Homo sapiens
ctcgccaagtaccgagctaatattttcttgattgtgtttgactcgctccatctcgggagtgacagctaaaggagttcccttgcccatgttttctttgtataacacctgtgcgatgagaaagcatccagaaaaacaaccatgagtaacatttcatttgttgagaggttttaagggtaaggtcaacttccttgttaagaaaacacagtcgtccaaggagccagaagttatatgctgacaaaatgccaccagctactttagtggaagctgttgttgggatggggaatctgcaccctctagagaagcagggacctcagctgctggggaaaggctgtcagagttatccatgttattttttttcatttttgtgagtacggtgcctcctaaacaatcacatgaggatttgagactgttagaactcagtgttgttatccacacaaacggaaacattcattatttttaaaaaatgattgaaaatatcagatgaagtaaaaaattgacattaactgtattatagaaatgggaaagtatatccttttgtaatataagatgtattagaagcaaagaagggaaatgggcttcaaacaaaaataaataaatgtaaagatcagtttaattctgaagttaagtggcattttttcccctttctttccaaaataccgagctaaggttttcttgattgtgtttgactctctgcatctcaggagtgatggggattggaattcctgtccccaggttttctttgtatagcacctgtatgatgagaaagcatccagaacaaaaaaagcaatcaatcagtcattttccccctgctttggagcagttgggagtgggaagggaggaagagagtaagttagaggaagagaaatacagaagcttttagactcaacctgtttgtttgagcctaaagacatcttcaaaagcaaaggaatgcaggaaagagcagcaaaaactaagaaataggaaaagaaaggttgttattttcattgtttgaactaatctctgcagcactgagcaaccgtgaaagagcaattagtcttttcccaccttgttacaaggagggaaaaaagtagaaacagacaagaaaccaaggaagttacttttgatttgaaaatgctgttaatcacatagggatatttgggttttacaaacattgtgtatatggagacacatacacacaactcttcttttgttcactttcaaaagaagtcagagtatttaatttttagtttgggtgaacacattgagaacaacgatgtttaaggcaaatggagagcaatgataaggtgcta

SEQ ID NO: 376536 - DNA, 838 bp, Homo sapiens
accagaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggacacccaaagtggcaaagaattggagtcacacaacgtgcatgtttccagctgaggtcaagcaaggttacgctctgcctttttgttttagttctcataccttaaacaggtgtcctttttataatccatgtaatgccacatttttcacttttctgtgcttttcctggtggtttcactgtttaaatttggaacctaaagcttgggtccaggtgctttctagtttgtgttcctaagcaaaggaaggctgtgatatacccaatggtgaaaataaactttgttcaggcatgatttatagagctactggctgtgagtttgatgttagtgattcatttgtataaaatatcttctaatagacgttaagcaggttatatattgaacagctgacaaaagtgttgtgtccagagaacctaaccctgtatttcccatgggagtgatcactcagtatttgccaatttagtgttcaaggctactttatataatagaaaaccataactactatgaataatgagagagaatcaactgtatgttca

SEQ ID NO: 376537 - DNA, 813 bp, Homo sapiens
ctctctccatctctggagtgataggtgttgggattcctttccccaaattttctttgtacaaaacctgtgagatacaagaaagtacccagaggacatttaaaacaggcacagagagtaaggaaggaaggaaatgggggaaggggttatatgtgaggaggcagttttttagtaagtaatatttagtaaggataatgtttttacttttttcacagttttaatgatgaactctacaatgctaattctggaaatgaaaaagtacaatggaaagcattaagttatataacgctgaggaatcttgttaattctacttatagtatttcaaatctagtcaagtcactgaaaatgttcaagtataatcggaaatgtgtctttccgatagccgttcctggtgagacatcctctttatataaaacctgggcattcagaatcaggacagtgttaacacagaagaaaagaaaacccagcagttcctggagaaagactaggacacatggcttttgtgaaaacaagacactagacgatgttcccaggggttttcgccatgaaccttgccatgggtgaggaaaagatactatattttctccccaataccaccaacgaagtaacagatgagtctttcatgctgtgatttgggattaagatacaaggtgagcccagagatgaattgggcacacatttcctggggcaggatgggagttgtggagggctgcacaacagccccactgcaagcctgggatatccagaggcatcttcctcagcacccctaggtgcctgtgggctgtgccttacatttaataaaaacttacaaggctg

SEQ ID NO: 376538 - DNA, 497 bp, Homo sapiens
ggccccctaagaaataccgagctaaagttctcttgattgcgtttgactctctccatctctggagtgataggtgttgggattcctttccccaaattttctttgtacaaaacctgtgagatacaagaaagtacccagaggacatttaaaacaggcacagagagtaaggaaggaaggaaatgggggaaggggttatatgtgaggaggcagttttttagtaagtaatatttagtaaggataatgtttttacttttttcacagttttaatgatgaactctacaatgctaattctggaaatgaaaaagtacaatggaaagcattaagttatataacgctgaggaatcttgttaattctacttatagtatttcaaatctagtcaagtcactgaaaatgttcaagtataatcggaaatgtgagtcattttgtattaacataattttggtcaggtaataatacacaacacacacagacacacacagaattgctgttaagatgttac

SEQ ID NO: 376539 - DNA, 341 bp, Homo sapiens
gattacaggcgtgagccaccacacctggcccacagcagctgtttttttactggactgttttgcagcacttaaactctcatagacatatcagtaaaactgtaggccctcagacaaagcaaagggtttcccctaccctctttttctttgctatcctctatgctctgcctcttgctttagtttcatacaacattcagcttatcattaaggaataaggtttttggctcttatatcactatcatggcgaatcagtggaaaatgagaaacatagtaacacatcatgataaatcctcaacctcggtatctcccctcagtgtcattcttggaaacgtgggagatttagg

SEQ ID NO: 376540 - DNA, 727 bp, Homo sapiens
gggtatattttatattttatataaatagctgcatagcagggaatgcattcttggacaggaggacttataaatatacttaagccatttttattcagtttttaattttttaattattgagttttaaatttatataacatgaaataattgaagatgggcattgtcaacaatgtaatttgcatcataatgaattttccaaattctaccattataagggtccaataggctaattctttgcatttgtccaatacattaattggaataatttatttggtaactacatgtgactggtactaggatgatgttagaaatgagctttgtctgagttcatgttttccagagttttaaaaagttaaaattagtctaccagtaatgtgtacagttcagatgttgatgtatataaacaaatttaggtaatacatatttagggcaaatacagttgtaatgttcatattttttccaaattccactttttagcctgtttgtgcatggaaacgatctgtaaaatggaatatattaaggctccatttaatgaaatttatattatgtgaggcttttaaaaactgtgacagttgtatagtttatagatcgatgttttcttttaccccataggtttgtgtgcctctgattcaaagtacaataagcattgattctaatgcctcacctcagggcaattcgtgtcatgtagctacatctccaggtttaaatcctatgactcctgtacacaaag

SEQ ID NO: 376541 - DNA, 329 bp, Homo sapiens
ctgataatttgtcgagttataaagagggatatatatttaaggcaacagtgggggttagtttaaaattgtcttaattttaaaaattgaaatagcaacatatattctgtgagttaatatttagtatatgttttgcttttattttttcgtttttcctagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagt

SEQ ID NO: 376542 - DNA, 9144 bp, Homo sapiens
accagaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgtgggtccagaagccttgagttttgctaagcaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaattatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttgtggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgcatattctggtgaaacatgtaaaatactttaagtaaaattgaacatttttatttgaatttttgctgaactgataaaggtgtttatatttttgtttgtttgtttgtttaattcatgtttgttgggactgaggtttaggaagtttgttactggttaaaaacctcaaatgaaatgcgaaagaatttgaatttttcctgcatatgtcaactttggacagctttcaagaaaaatgagaaaagtttcaacttctggcggttaaaatattaatgcagaatttactaagattttattcatttgcattagcaaatattcatgcagcagcagttgactgaaaatttattcttatgagacgtatagtattcatttttaaatgcatgattgtacattatgtatagacgacaatgtttttaatttataaatttcattctttgttaattgcatgggtttttctgcagcttattgtgaataccttggttctgttcaatagaaacattttgtatatattaaatactgaaatatcagtatcgacggtggaagtgcttcatgggcttgctgcacatatttgtaggatactgtatctgcaaatgcaacaacaaatagttttgtacttggttaacagtcttagttaaaacatgagtttattttctaaaagtatccagaataagtaaaattatagaaataagaaaatgttacacaactttgctgttcatacccttaccttcttactacttttggtttggaggagggtatcaccactagaaagtgtgcctccttaagatttcttaaaggaaagttagtttcagtatttcacagcaagttggactacaaaatctagagttgatctgctttttaaaccttcatttaaaagcaaacttggaagaaatttgaaactgatgtttttaatatatgtctgtgttgcctaggttttctttttttaaagaggtatgtaattaaaacctttgtaaaatttgccaactaatattagtgcctgacttcccatatttgtttcatctttttaactgacagtatatctcacttcttctttgaatagaatgagtgagtgatctcagttttcacattttattcagaagctaatccctacttagcaaggcacacattctacagcaagtcatagaaagtttaatccttgtgcctccttagctctcgtatattcagggatctctataaaagttggtgtcttttttcatcatcataaattcatcataatcacagatatttttgggtctaagatattcatataccaaggatggttttgtaaagaattctgggatcattgaattaaggattgtggcttgaagtaactaaagaaaaatactaatttccttaaaaggaattataattatgatttacattttacatcattaatttcccaaattatatttaaccgtaaggaggtgcacatgagtttttagcaaacaggtatgaataagcagctatgtatatgtgtttggggcagaggggagcagattactttaacacacttcagaattaaaatcagttcgtttcatgactctgtgccttaacgtttgtgtgaactaaacttgctgattgaatgaaattcttgggaagccgaacagtaatagcagaaaatgtgaccaaatgagtatcatgtacttaaatcactgaattttatataagcacaagtattaattttaaaaacattatagtttaataaagctgcatttaaaaatatttgggagcaaagacaagcatgctaaatcttcattttgctatggctataagcatatatttttggcaacttatttgcaatattcttgccttaaagtttcctgcaaatttcccccttagtaattcccgaatagcaaaacattaatattccatgattagctctattgtgttgtctcactattaaaatggaattcgttttttcaaatcttttctaatggttaataaaacaaatgtcagatcataataacactcaaatgt

SEQ ID NO: 376543 - DNA, 7775 bp, Homo sapiens
accagaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgtgggtccagaagccttgagttttgctaagcaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaattatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagcataataccacttcagccaaaggatttctgtccccaggatcacgtagccctaaatttaagagctcaaagaagtgtttaatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttgtggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgcatattctggtgaaacatgtaaaatactttaagtaaaattgaacatttttatttgaatttttgctgaactgataaaggtgtttatatttttgtttgtttgtttgtttaattcatgtttgttgggactgaggtttaggaagtttgttactggttaaaaacctcaaatgaaatgcgaaagaatttgaatttttcctgcatatgtcaactttggacagctttcaagaaaaatgagaaaagtttcaacttctggcggttaaaatattaatgcagaatttactaagattttattcatttgcattagcaaatattcatgcagcagcagttgactgaaaatttattcttatgagacgtatagtattcatttttaaatgcatgattgtacattatgtatagacgacaatgtttttaatttataaatttcattctttgttaattgcatgggtttttctgcagcttattgtgaataccttggttctgttcaatagaaacattttgtatatattaaatactgaaatatca

SEQ ID NO: 376544 - DNA, 7947 bp, Homo sapiens
accagaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgtgggtccagaagccttgagttttgctaagcaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaattatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttgtggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgcatattctggtgaaacatgtaaaatactttaagtaaaattgaacatttttatttgaatttttgctgaactgataaaggtgtttatatttttgtttgtttgtttgtttaattcatgtttgttgggactgaggtttaggaagtttgttactggttaaaaacctcaaatgaaatgcgaaagaatttgaatttttcctgcatatgtcaactttggacagctttcaagaaaaatgagaaaagtttcaacttctggcggttaaaatattaatgcagaatttactaagattttattcatttgcattagcaaatattcatgcagcagcagttgactgaaaatttattcttatgagacgtatagtattcatttttaaatgcatgattgtacattatgtatagacgacaatgtttttaatttataaatttcattctttgttaattgcatgggtttttctgcagcttattgtgaataccttggttctgttcaatagaaacattttgtatatattaaatactgaaatatcaaagaacaacaacaatcataaacaaacaatttgtggcgcgcttgctcctgaaaggtttttaacacccttgtggcgccccgccatgtgatgtgcacgtgccacggtgtccaggacccggctggacatggtggctcttccaaaaacgcgggacggttctaacacaggctggcctggtcaaggacagcatcccgcggtggtattcatgcatggacagccacaccccctcctccccatacgaccaacctaccgta

SEQ ID NO: 376545 - DNA, 8556 bp, Homo sapiens
accagaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgtgggtccagaagccttgagttttgctaagcaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatggaactccagctttgttcttaattcaattaattttcaacaatttcttggaatgtggtgtatcagatgaaaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcagaccaatgaagtaaatcaaggtgatgccttagaacataattttagtgccatctatggtgcattgactttaccagtaaaccacattttttcagaacagagatttccagtggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctaatttgttgttcgtggatagaattatttatattattactgtaatggttgattgcattgacttctcaccatataatattaaatatcagcccaaagttaaatcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagcttgatgaagttcctaaagtatatagttgtctgaacaacaagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaaaccagtactaacacaagccaaacaaaaatttctgctcctgttgcctggtttggaaactgttgaaatgatggaggaatccagtggaccatattctgatggaacagaaaattcacaactaaatgtgaagataagtggcatggagagaaaatcaaatggaaaaagagattcatttttggcacaaacaaagaataaaaaagaaaatatgaaaccagcagccaaactgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtgtgatattcctgccatgtataataatctggatgtttcccaagataccttatttactcagtatagtcaggaagagcctatggaaattcctactttaaccagaaaaccaaaggaggattctaagatgatgattacggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaattatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggttcgccgtgtctcctttgcagatccaatataccaagcaggattggcagatgacattgatagacggtgctctattgttaggtcccattcttccaatagttctcccataggaaaaagtgttaaaacttctcctactacacaatctaagcataataccacttcagccaaaggatttctgtccccaggatcacgtagccctaaatttaagagctcaaagaagtgtttaatttcagaaatggccaaagaatccataccatgcccaacagaaagtgtttacccaccattggtgaactgtgtggcaccagttgacatcattttacctcagattacatcaaacatgtgggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtgaagactcgtggactagaagagattccagtttttgatatttctgaaaaaacagtaaatggaatagaaaataaatctttgtcacctgatgaagaaagacttgtctcagatataattgatcctgttgctttagaaattccattatccaaaaaccttgtggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatccttcctttctccaaagaacagttaaaaccaaatgtgttatggtaagctgtaaataccgttggaataaaagataaccgttcatcttacctaaaaaattgaagacaatattttccattgttgatgtcacaatttcttgaagatggctctttgcagcctacgtggtagtggagatatatacaaaggacttccctagtatcgttggaccaacaagcacaagcagatggcaggaagattagaacattggatattgattgccagtttttaagtgtcattcttggaaacgtgggagatttaggaaatgacattgaagaggaagaattctgttgaaatagtgattctcaacgtggggtccttggacagcaaggatgaggaaaaaacacagtcatccaaggagccagaagttatatgctgacaaaatgccaccgactactttagtggaagctgttgttgggatagggaatctgcaccctctagagaagcagggacttcagctgctgaggaagggctgtcagagttatccatgttattttttttcatttttgtgagtacggtgcctcctaaacaatcacatgaggatttgagactgttagaactcagtgttgttatccacacaaacggaaacattcattatttttaaaaaatgattgaaaatatcagatgaagtaaaaaattgacattaactgtattatagaaatgggaaagtatatccttttgtaatataagatgtattagaagcaaagaagggaaatgggcttcaaacaaaaataaataaatgtaaagatcagtttaattctgaagttaagtggcattttttcccctttctttccaaaataccgagctaaggttttcttgattgtgtttgactctctgcatctcaggagtgatggggattggaattcctgtccccaggttttctttgtatagcacctgtatgatgagaaagcatccagaacaaaaaaagcaatcaatcagtcattttccccctgctttggagcagttgggagtgggaagggaggaagagagtaagttagaggaagagaaatacagaagcttttagactcaacctgtttgtttgagcctaaagacatcttcaaaagcaaaggaatgcaggaaagagcagcaaaaactaagaaataggaaaagaaaggttgttattttcattgtttgaactaatctctgcagcactgagcaaccgtgaaagagcaattagtcttttcccaccttgttacaaggagggaaaaaagtagaaacagacaagaaaccaaggaagttacttttgatttgaaaatgctgttaatcacatagggatatttgggttttacaaacattgtgtatatggagacacatacacacaactcttcttttgttcactttcaaaagaagtcagagtatttaatttttagtttgggtgaacacattgagaacaacgatgtttaaggcaaatggagagcaatgataaggtgcta

SEQ ID NO: 376546 - DNA, 1423 bp, Homo sapiens
accagaagcattaaatgttatcgtaaggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactaaattaatctcagaacttcagaagctatttatgagtaaaaatgagacttacgtgttaaaattatggcctttgtttgtcaaactacttggaaggaccttgcatcgaagtgggagtttcatcaattctctcttgcaactagaagaacttggatttcgtagtggagcacccatgattaaaaagatagcttttattgcttggaagagtttaatagataattttgctttaaatccagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtttgtgtgcctctgattcaaagtacaataagcattgattctaatgcctcacctcagggcaattcgtgtcatgtagctacatctccaggtttaaatcctatgactcctgtacacaaaggtgcttcctccccgtacggagccccgggaactccccgaatgaacctgagttcgaatttaggtggaatggccacaatcccatccattcaacttttgggacttgaaatgttgcttcatttcttgtgggtccagaagccttgagttttgctaagcaaataaacttgtgctgagcttagagccattggaacatccgttaatcagcagcccttcctttttttccaaacatgcaaatacacttatcactgctgttcatgatagctttgttgcagttggaaaagatgcccccgatgtggttgtcagtgctatctggaaggagctaattagcttggtgaagtcagttactgaatcaggtaacaaaaaagagaaaccaggttctgaagttttgactctcttattaaagtctttggaaagcatagtaaagtctgaagtatttcctgtatcaaaaacgctggtcctcatggaaattacaattaaaggacttcctcagaaagtattaggttcaccagcatatcaggttgctaatatggatattcttaatgcaagtatcttaaatgtaatatgatgaagattggccaaaaacatttatacttcccttttttattttattttattttattttattttattttatttatttttgagacggagttttgctcttgttgcccaggctggagagcagtggcacgatctcggctcactgcaacc

SEQ ID NO: 376547 - DNA, 736 bp, Homo sapiens
agcgggtgacgctcagccgggccttgtggagtgcgggtctctgctgcggacgccgggggccggcgcggcgttggccgcccccggcctcgccgagtgcagcgcgcccgaaggccagtgcctgcgctccgtccgcggcccggcgcccagggtgggcggggaggccgccgcgcagtcgccgcacgctacaccgccggcgccgtcgtttcgcgtcgcccgcttccggccaccgcggccgccattttgttcgcgcggaagcgccgcggtagggtgggaacccaagcgggagagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttcattactttaagagaggaatctccgctagataaaagtcaccttaatagctgacaaatgtctttcctacctaatagataatgtattaataaagatcgagtctaagccaagaaacttgcagagttctctagttgttctcagtaataaaacaatgtcattgaatttccattctttatttggcagtactgtgctctaatgacaaaggttctgtgacctttcaattatgatcatgactaagacacaaagactggaattctatagaagaggcctgacagatcacctgagctcagcgtttgagaccagcctgccacatacgatc

SEQ ID NO: 376548 - DNA, 1491 bp, Homo sapiens
agcgggtgacgctcagccgggccttgtggagtgcgggtctctgctgcggacgccgggggccggcgcggcgttggccgcccccggcctcgccgagtgcagcgcgcccgaaggccagtgcctgcgctccgtccgcggcccggcgcccagggtgggcggggaggccgccgcgcagtcgccgcacgctacaccgccggcgccgtcgtttcgcgtcgcccgcttccggccaccgcggccgccattttgttcgcgcggaagcgccgcggtagggtgggaacccaagcgggagagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcccgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcaggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtcaggaaggatcatcaggaacaagacccgaggggacccagagctgacgagacgcgggagatcaaagcaggtaccggaaatgggcgcatgaggccaatgaacggagtccggaaccacagctcgctggcacacccgggggtagatcggccgggacccctagtaggaagcccttcagtcaaaaagccggttacccggatatgagacga

SEQ ID NO: 376549 - DNA, 1111 bp, Homo sapiens
  misc_feature (1095)..(1095): n is a, c, g, or t
  misc_feature (1098)..(1098): n is a, c, g, or t
  misc_feature (1110)..(1110): n is a, c, g, or t
agcgggtgacgctcagccgggccttgtggagtgcgggtctctgctgcggacgccgggggccggcgcggcgttggccgcccccggcctcgccgagtgcagcgcgcccgaaggccagtgcctgcgctccgtccgcggcccggcgcccagggtgggcggggaggccgccgcgcagtcgccgcacgctacaccgccggcgccgtcgtttcgcgtcgcccgcttccggccaccgcggccgccattttgttcgcgcggaagcgccgcggtagggtgggaacccaagcgggagagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcccgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacatctcctcgggnatnctctagagcggnc

SEQ ID NO: 376550 - DNA, 898 bp, Homo sapiens
ccaagctgctcacaccaacctgctcacacggaacagggactcacgtgaagcttccaggaccagctcccgacaagcccaatgtttatgatttcaaaaccacatatgaccagatgtacaatgatcttcttaggaaagacaaagaactctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcccgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcaggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtc

SEQ ID NO: 376551 - DNA, 1235 bp, Homo sapiens
agcgggtgacgctcagccgggccttgtggagtgcgggtctctgctgcggacgccgggggccggcgcggcgttggccgcccccggcctcgccgagtgcagcgcgcccgaaggccagtgcctgcgctccgtccgcggcccggcgcccagggtgggcggggaggccgccgcgcagtcgccgcacgctacaccgccggcgccgtcgtttcgcgtcgcccgcttccggccaccgcggccgccattttgttcgcgcggaagcgccgcggtagggtgggaacccaagcgggagagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcccgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcaggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtc

SEQ ID NO: 376552 - DNA, 883 bp, Homo sapiens
  misc_feature (1)..(1): n is a, c, g, or t
ntgttctggcaacactctcttaatcgtccaccgctacaacaaacgggcgggaacagggactcacgtgaagcttccaggaccagctcccgacaagcccaatgtttatgatttcatgtacaatgatcttcttaggaaagacaaagaactctatacacagaatgggattttacatatgctggacagaaataagagaaagattccagaactgcaaagacctgtttgatctgatcctcacttgcgaagagagagtgtatgaccaggtggtggaagatctgaattccagagaacaggagacctgccagcccgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcaggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtc

SEQ ID NO: 376553 - DNA, 716 bp, Homo sapiens
aatagctgaacgactctcttaaactccaccgctacaccataaaagctgatccacaaacgagaggagcaccagtcctcctcttggcttcgagatggcttcgccacaccaagagcccaaacctgggagacctgccagcccgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcaggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtc

SEQ ID NO: 376554 - DNA, 587 bp, Homo sapiens
agtagagacggggtttcaccatgttggccaggctggtcttgaactcctgtcctcaagtgatccgcccgcctcagcctcccaaagtgctgggatcacaggcgagagccaccgcgccaggcccatttttcaagcggatggaccctgtgtggagctggcggtggagcagggagggctggtctttagtgacggggaagggtcgcaatgccagtcacggttcaccccaggactggctggtgggtggggagtcccagaccagcttgtgctgagttggagatttgctcaggtttcctcgaaccatcagccgccttcggtttgaggctcattcattgtgctccccaaactgcagagtccagaaaccactggggctgggctgggcctgcagccggcagagctggggactcagccacattgactgcctgttccctggttttggagcctctgacgtctgtgtcaccttgtcccaatcagatctgaattccagagaacaggagacctgccagcccgtgcacgtggtcaatgtggacatccaggacaaccacgaggaggccaccctgggggcgtttctcatctgtgagctctgccagtgt

SEQ ID NO: 376555 - DNA, 1288 bp, Homo sapiens
agcgggtgacgctcagccgggccttgtggagtgcgggtctctgctgcggacgccgggggccggcgcggcgttggccgcccccggcctcgccgagtgcagcgcgcccgaaggccagtgcctgcgctccgtccgcggcccggcgcccagggtgggcggggaggccgccgcgcagtcgccgcacgctacaccgccggcgccgtcgtttcgcgtcgcccgcttccggccaccgcggccgccattttgttcgcgcggaagcgccgcggtagggtgggaacccaagcgggagagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcccgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcaggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtc

SEQ ID NO: 376556 - DNA, 624 bp, Homo sapiens
  misc_feature (205)..(205): n is a, c, g, or t
ctctagaggtgtcccaaatctctcattgcgagctcacttccactatgtcctatcaataggagctgtatttgccatcataggaggcttcattcactgatttcccctattctcaggctacaccctagaacaaacctacgccaaaatccatttcactatcatattcatcggcgtaaatctaactttcttcccacaacactttctcggnctatccggaatgccccgacgttactcggactaccccaatgagagatttaaatctctcagtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcagagatttaaatctctcattgcgcaacacatcctatcagactgggtctggcccttaaattctctgtgtactattatgagattctgaactcccccagagaaagctgctctcttgcaaagacagcttttgatgaagccaatgctgaacttgatacattaagtgaagagtcattcaa

SEQ ID NO: 376557 - DNA, 1347 bp, Homo sapiens
agcgggtgacgctcagccgggccttgtggagtgcgggtctctgctgcggacgccgggggccggcgcggcgttggccgcccccggcctcgccgagtgcagcgcgcccgaaggccagtgcctgcgctccgtccgcggcccggcgcccagggtgggcggggaggccgccgcgcagtcgccgcacgctacaccgccggcgccgtcgtttcgcgtcgcccgcttccggccaccgcggccgccattttgttcgcgcggaagcgccgcggtagggtgggaacccaagcgggagagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcccgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcaggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtccccgatgcggccgaaatttactcacatatacccacaccagcggtaataaaaaaaaaaaa

SEQ ID NO: 376558 - DNA, 758 bp, Homo sapiens
aacctaagtgctagtacgagcctgtgttaatcggacgagggaaataagagaatcaagccccggccagaaagattccagaactgcaaagacctgtttgatctgatcctcacttgcgaagagagagtgtatgaccaggtggtggaagatctgaattccagagaacaggagacctgccagcccgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcaggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtc

SEQ ID NO: 376559 - DNA, 1199 bp, Homo sapiens
agcgggtgacgctcagccgggccttgtggagtgcgggtctctgctgcggacgccgggggccggcgcggcgttggccgcccccggcctcgccgagtgcagcgcgcccgaaggccagtgcctgcgctccgtccgcggcccggcgcccagggtgggcggggaggccgccgcgcagtcgccgcacgctacaccgccggcgccgtcgtttcgcgtcgcccgcttccggccaccgcggccgccattttgttcgcgcggaagcgccgcggtagggtgggaacccaagcgggagagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcatgtacaatgatcttcttaggaaagacaaagaactctatacacagaatgggattttacatatgctggacagaaataagagaaagattccagaactgcaaagacctgtttgatctgatcctcacttgcgaagagagagtgtatgaccaggtggtggaagggagacctgccagcccgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcccgcctctggagcttcctgttgttcatactttttccttcctgacatttgtttttacttacaggtgttctgctggtgacggtagcattacccaaataaactatgccaaaacgccagatgaaagcaatcaagtttcttcttttccacttttacttatgagcaggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtc

SEQ ID NO: 376560 - DNA, 871 bp, Homo sapiens
cttcaacctatctctcacaccaatcagatcttcggcctgagcgagacggacccttcctccttcctgtattatcgtcccttctataccatcctgggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactga

SEQ ID NO: 376561 - DNA, 563 bp, Homo sapiens
cttcaacctatctctcacaccaatcagatcttcggcctgagcgagacggacccttcctccttcctgtattatcgtcccttctataccatcctgggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccatcaggaactccgggaagtcaatggtcccccccgggaa

SEQ ID NO: 376562 - DNA, 630 bp, Homo sapiens
tgcgtgtgatactctagagatcccctgtatctgggagggtactggcagatcaccgtgacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgtatccggggaggtcgtccccaagggcaccccagctgggccggtagatctgaaagatggtgatccaggaggtgagcactactcaccagaagaggacgcccacagctgagcgccagacatagcctttgatttggctctgtgctgtgtaggctgagacaagggaaggcctctcggaagaaccagaaggatgtagaccaaccagagacacggcaggaaagcacaccccccccggatactccccgggataaagggtac

SEQ ID NO: 376563 - DNA, 302 bp, Homo sapiens
  misc_feature (52)..(52): n is a, c, g, or t
  misc_feature (83)..(83): n is a, c, g, or t
ctcccaaaaaaaaaaaaaaaagtttttcccccggggagccccccctcttccnccccccccccaaaaaaaaaaaaacgcagctnctactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactga

SEQ ID NO: 376564 - DNA, 348 bp, Homo sapiens
aggatccccagtgcgtagtcagtgtcaatgctgataacatgtgtctttcaatccccttctcacaaatatacacatacataaaggcacaatacttatacatgtgacacacagacacatgtgttaaaaaggtaagtgctgggcctggcttccccaatacctgagtacccactgacaacggggcctctgtcctgtgcccactttagatgtatctaattctcctgactgttcttcccaggggagtgtggaggtcttggccctgttccctgtcctaccaataacgtagaataaaaacataacccactgaacggcctcactgacacggcctcactgcaacgcctgggatactct

SEQ ID NO: 376565 - DNA, 447 bp, Homo sapiens
accacacattcaaactataaggcctgtgttcttccaaacgtagttccaccactcccccgctgtgtgaccttgggcaggtggcctcacctccctcaggctcagtgtcctcatggtaagtggaaacaacagtgacggtgcccactgcatgggccctggcctaagaggaaaagaaaccacattggtcacaccccaggacagccctggaaagtgcccaatcaacggtcgctctgaggaggcaacagcagatggtcacacaaatggacgaacaaaaaaattcatgtcttctcccctcactttccacagcgatgacaagagtggcagcgtggtgatctttggtggcattgactcttcttactacactggaagtctgaactgggtgcctgttaccgtcgagggttactggcagatcaccgtggacaggtgagactgccatgaacgggcagcatc

SEQ ID NO: 376566 - DNA, 378 bp, Homo sapiens
gagttgtgacccacactggctaaccaagatcaggaagaaaaggttgagtgttatcataagcttctcttctctcactaatggggtcagacgctggtgacgttgatagcacacaggctatccgggagggaatacgcactccagtgtggagagcgaggggagctgcatcagtggcttccagggcatgaacctccccaccgaatctggagagctttggatcctgggtgatgtcttcatccgccagatgtggagagagggagagagccagtgtggagagagccagtgtggagagagggagagagccagtgtggagagagggagagagccagtgtggagagagccagtgtggagagagggagagagccagtgtggagagggtcc

SEQ ID NO: 376567 - DNA, 609 bp, Homo sapiens
ctcgagttggtacctgccagtaccctcgacggtaaggcagatcaccgtgtacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactga

SEQ ID NO: 376568 - DNA, 893 bp, Homo sapiens
cttcaacctatctctcacaccaatcagatcttcggcctgagcgagacggacccttcctccttcctgtattatcgtcccttctataccatcctgggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaaggtctagtggagctgcttct

SEQ ID NO: 376569 - DNA, 938 bp, Homo sapiens
  misc_feature (872)..(872): n is a, c, g, or t
cttcaacctatctctcacaccaatcagatcttcggcctgagcgagacggacccttcctccttcctgtattatcgtcccttctataccatcctgggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactganaacggcttcactgacaatggtcctctcctcccaccccatggaatcaagctcttttccctgcattca

SEQ ID NO: 376570 - DNA, 915 bp, Homo sapiens
cttcaacctatctctcacaccaatcagatcttcggcctgagcgagacggacccttcctccttcctgtattatcgtcccttctataccatcctgggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaacggcctcactgacacggcctcactgcaacgcctgggatactct

SEQ ID NO: 376571 - DNA, 810 bp, Homo sapiens
cttcaacctatctctcacaccaatcagatcttcggcctgagcgagacggacccttcctccttcctgtattatcgtcccttctataccatcctgggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagagagagagccatgtggagagagggagagagccagtgtggagagagccagtgtggagagagggagagagccagtgtggagagagggagagagccagtgtggagagagccagtgtggagagagggagagagccagtgtggagagggtcc

SEQ ID NO: 376572 - DNA, 514 bp, Homo sapiens
tacatatacgaactcgagttggtacctctctccactggctctctctacactggctctctctctctctctctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagggtaccaactcgagtcgtatatgtaa

SEQ ID NO: 376573 - DNA, 633 bp, Homo sapiens
cttcaacctatctctcacaccaatcagatcttcggcctgagcgagacggacccttcctccttcctgtattatcgtcccttctataccatcctgggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagggcgcccaatgggcgcacgaaaggccggtatatttcaaaccaaaaacctttttctgggggtctgaatgagccgtcggccaatggggcgccctttaaccgggcgtcc

SEQ ID NO: 376574 - DNA, 392 bp, Homo sapiens
tacatatacgaactcgagttggtacctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagggtgtcctaaggcgagctcagggaggacagaaacctccagtgtggagagag

SEQ ID NO: 376575 - DNA, 485 bp, Homo sapiens
cttctcccctcactttccacagcgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccattgcaaagtgggagtaggaagtgtgacaggaataaagacagggaaaatgtcaataaacaaataaggaaaaacagaaatactggtagatcaggtatgctctaaagaaaacaaggctgggcttctgtgacttgtcttg

SEQ ID NO: 376576 - DNA, 652 bp, Homo sapiens
tacatatacgaactcgagttggtacctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactga

SEQ ID NO: 376577 - DNA, 696 bp, Homo sapiens
tacatatacgaactcgagttggtacctctctccactggctctctctacactggctctctctctctctctctctctccacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactga

SEQ ID NO: 376578 - DNA, 689 bp, Homo sapiens
cttcaacctatctctcacaccaatcagatcttcggcctgagcgagacggacccttcctccttcctgtattatcgtcccttctataccatcctgggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccaggtggagagagggtaccaactcgagtcgtatatgtaa

SEQ ID NO: 376579 - DNA, 459 bp, Homo sapiens
tacatattcgaatcgagttggtacggagcagcgagaactcagattagacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactga

SEQ ID NO: 376580 - DNA, 562 bp, Homo sapiens
cttcaacctatctctcacaccaatcagatcttcggcctgagcgagacggacccttcctccttcctgtattatcgtcccttctataccatcctgggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtggagagagggtaccaactcgagtcgtatatgtaa

SEQ ID NO: 376581 - DNA, 352 bp, Homo sapiens
cttcaacctatctctcacaccaatcagatcttcggcctgagcgagacggacccttcctccttcctgtattatcgtcccttctataccatcctgggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacaggtggagagagggtaccaactcgagtcgtatatgtaa

SEQ ID NO: 376582 - DNA, 375 bp, Homo sapiens
tctttcccatcatccatctcaatggatggatgttttacttatatttgtctgaaaaataatgattctgtcagttatcaataatctttaactttatgctaaagaaactcatcattatctaatgagttttgccctttgcggtcatcagtgccagtgtccttggaggaaactcaccaaaactgaagtcagtcgagtcagacctgagacttaaagacctaaaagcagagacttcctctatcctggtagcaacaagtaaagaggggaagagagaggtcacttcctagaacagagggcccctgaaagattgttttggccaattctctgtttctacataggatttctcattcctcattcctgagcaattgcttataggtacac

SEQ ID NO: 376583 - DNA, 425 bp, Homo sapiens
ccattgggttacttcccagtttttgggttattcccaagtaaagctgtttgaacaagtacaattatttgaatagacataaagcatggcaatgttaatttcaatgtagaattcaaaccaaaatgtattaactacaataagagagagctttatattgctgtctaccaaaaagatacaggtcaatagctttcatataagcctttacaacaactttccattgttgtaaaagatctattctgaacaaaacaccaggcccagataatttcaaagttgtgccaaactttaaagaaatgatcatttccagttttcaaacagtttcaaaacatagggaaaaaatagtaagcttccaaattatcttgaggctagcacagccccgatccaaaaacctgacaaagtggcaacctccttcccctattaaaaaaaaaaaa

SEQ ID NO: 376584 - DNA, 456 bp, Homo sapiens
tgagacggagtctcgctctgtcgcccaggctggagtgcagtggcgcgatctcggctcactttacgctccgcctcctaggttcacgccattctcctacctcagcctcccgagtagctgggactataggcacccgccaccacacccccctaattttttgtatttttagtagagacggggtttcactgtgttagccaggattgtctcgatctcctgaccttgtgatccacctgtctcggcctcccaaagtgctgggattacaggcgtgagccaccgcacccggccatgtctcccaaatctttagcccagatcctgcttccatgcttcagacaatttgctcaaatatctagttgacaactctatttagatgtctttttgccactaccaactcaatatatttaaagtgactttatcaccttcctctgtcaaatttgccttttcttgtgttcccatcttagt

SEQ ID NO: 376585 - DNA, 334 bp, Homo sapiens
tggaatctaagtctagccatatgagtgatagtagaaacaatagaaacatttaaccactaatttcctatttcttgatcaaagaaaaaaaggtaagaacttattattttctcagtaggatgttatatgttccaaagctttctgagggaaatctttcccttctctctcaaaactctcctaaaactctcaaaaagccttccccataatgagggaaaatctcaggactcaattcctcttctctttttccccacccaatttcagcaattagtagacatgttgaacagggtaaacatgaaagtcatacagaaaggtaacaaacggtaattaaaataccttg

SEQ ID NO: 376586 - DNA, 349 bp, Homo sapiens
gctttttagcactttcaatatcattttagcatttgattcagattggttggttttgaggatgggagaagaggggaatttgtattgaccgtaaggcttggtggtggctgcaccactgcaccaatctgggaaccatttaagtccctcagaagactacagtcctgcaccatataatgacatttcagtcaactgtgaacagcacatacgacagcggtcccataacattataatggagctgaaaaattcttattgcctagtgacattacagccatctgaacaccacacattactcacattctatgatgctgctgctgtaaacaaatgtacaaagctgacggtcatataaaagtat

SEQ ID NO: 376587 - DNA, 548 bp, Homo sapiens
atccaaattccaatgccccaaaataatcttttattggaatagggccccaactcattcatctggctgctgttgggttaaaacaacagagttaaatagttgcgactgagatcctatgactgaaacctgaacacattatttaacccttggaagttttcttagcccttctctggaagccaaaagctaagactgaagcacagccttaagtacatatagttccttttcccaaagtatgtattaacagcatacatttaaaaaataaaaataccccgtttcaaacacattaaagtttgttcataatttgaggaaacatcctttcacctaaatagaatttaagtttctaattccaatactatgctatcttctagttcagatgttcaagctagtgtttacgcccaggcagtttctggcactagagattaagataaaatttatgctattttccgagagctatgatcctactgcaaaaatttaattaggaaatgggcggccgcgcatggtggctcacacctgtaatcccccagcactttgggaggccgaggggggcagat

SEQ ID NO: 376588 - DNA, 574 bp, Homo sapiens
ttttgtaaggcacttgcaagattaaaaattgttccttctccacttctaagaagatcaaaatatgagaaataaaaacttagactctacagggaaatatttattaacacgtttgtatctatttataatatatacattcagagtgattatatttttggcaagaaatgccttcttgaagacccccaaaattaaagtgtgcatgcataatcgagactgattttgaaagatgataggaatttttatgagaaatttaaattgattctgtcagctctgaaataaatacatctttactatattttaatatggaagtttgcataattccagtatgtatgcaaaatgcaagactttattatatgagtttatgggccagaaatcattttgctcttagaattaatttgattttggcaaatacttcaattttctaagatccttctttaagccctgttacctggaaacctgaaaaaaataaacaacttttgggcttgagagggatgtctgggcaattagaatagctacactgaagtctgcccgtgtgtgtgtgtgtgtgtgtgtgtgtgtgtgtgtgtgtgtgtgtgtg

SEQ ID NO: 376589 - DNA, 526 bp, Homo sapiens
atgaagctctcagttcagagatcaagatgattgggggataagaagaagaaaaacattcctgcaggactagtctgggcagaagaggagttgtggtaactagatatgaggagaaagagaggaaggaggcacagagcagttggagcttgctgcctggaagaatgacgttttagagacaaggtctgactgtgttgcccaggctggacttcaactcctcagtacaagtgatcctcctgcctgagcctcctgaatagctgggactacaggcctgcaccaccataccctgctcttagttacacaaatcttaaaatgatgctgttatgttaattcaattaagaaagtaaactagttctatgatccaagcacatagttgtgactcaattcatgttgttgtttttaatcctgaaatgatattgtaaaataagagctttgccttaaagtttttgttactcagtttttacatttgaggtaagaaggcaagtggcagggaagaatgattagcaataaagctttttaaaagttcttcaga

SEQ ID NO: 376590 - DNA, 666 bp, Homo sapiens
attacaggcatgagtcactgcacctggcctgggaataacagtttaaggccagcctcttaaaatgaaagttattgtggcaacttctaaaagatgggttgaaaagagaggaaactggggataacatcataaatagattattatattatccctggtgaaagaaaatgaaggcctgaaacaaggcagagaaggcaaagataaacttgatatctaatggaatatgggtaagtaaccatataagttatcagccaaaatgggacatgcttaagagtcaaagaaggcactattaataattactccagcatatcaaaataccacattataccccataaatacatacaatttgtcaactaaaaataattttttttttaattcatgagggggataagaagaagatgaggagaaagagaggaaggaggcacagagcagttggagcttgctgcctggaagaatgacggtatgataaagagatgggatgatgtgaaataattcacattgttaattatgaagtgtgttttgaatcacctcagtgttacccagaaacgacactcggttatcatgttcagataggggacaatgtgtttttgcagtgatagcagtggaggggaagggttgtcagcttaaggggcagttggtcattctgtcatcaaatgaattagtagcaagact

SEQ ID NO: 376591 - DNA, 854 bp, Homo sapiens
aatacaatccctgtcctaaattaaagctattcagtaaactgagacaaagtatttgaaatgaaaagtaatcttttagacactcaaatgtctaattaaggcttgcacctcccattcccccgagtctcccttccctctcctaccctctatcttgccctgagaatgacaggaaggtggtgggagatttccttctaaaaataaatttcatcaataaactgttaaaaaaaattaattatacacactactaactctcaacagaaagcgaaactgagccttgctccaaagagaaaactgatccttgatctttttactttcatgtagtataaagttggaatgtcttaagttattccttcttaaaatcatgtatttccatttaaaaaaaatcttattttaatgttattcccctgagatccttccttcatccaaatcttagttaccagcattcagagtctaagttacacttgattatatttttctttctttcatttcattcttcatattattcccaggtgattatattatttacctaaaagctaaatctggttcaatgtttttttccatagacactgtctaagtatttctgaagaaaaccaggtggaacatgaatcatatcctaccatctggatgaatataaaccaaattaagagctatatgaggctgcaaaaatatttgagggcatgcttgaattttgaggaattgataaaataacagccaggcacggtggctcacacctgtaatcccagctctttgggaggctgaggtgtgagaatcacttgaacctgggaggtggaggttgtagtgagccaagattgcgccattgctccccagcctgggcaacaagagcgaaactcttattc

SEQ ID NO: 376592 - DNA, 4753 bp, Homo sapiens
  misc_feature (14)..(14): n is a, c, g, or t
  misc_feature (22)..(22): n is a, c, g, or t
aagcggctggtacngtccgggnggtatgggatccgcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggtgagggttccaccgcccttccctgctcacctgtatgtctcctgccactcgcgttccccataaggtgtcaggaccagggctttgcactcctgcagcaagtgggccagtgaggattccccaccccgcccaggcccacccccaccccgtacttcccaggactgagggacaggctcggcctaaaaggtagatttcttccttctaggttttgtttcagttgaatacctgctaccatccatttgggtgcagttttttgttgaaaaaattttaatggccaataacttactgcattcaaagtgaggagttttataagggttttatttttaataagatgaatagtttaagcttcgtgtctagccctgcaccctcttagcctaacagcacacctcgagcgctgtgccctgggctgctgacgtggcggcaggccgctagcagcagtcggccacctcctgaggcgggcagcacaggcctgctgtggacactctaggtctggccttgtattttgtggtctcagaagcctttgtggggacttctagtgtagggaaggcagtctctctgggagctcctgcaatgccaaactcttagcccaggttcactcctccgatccaagcctggcaggggtggggcatcatggtgtgtaggtatcaggcaggacttgtaagccatcccgtcaagtcaaattctggcttaatgtgtctttaggtagatgacctctgagccacagtttcctattctatgaattggggtttagtaaatctctcgggactgagagccaatgaggccatgtgtgcacacaaaatgctgggcacaaatgaggggctcagcggggctgagaagtacatcccatccagtgccgacatccgcttgcatggtgccctggtaaccttgcctctgccctccccaggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcagatcacgaggtcaggagattgagaccatcctggctaacaggtgaaaccccgtctctacttaaaatacaaaaaaaaaaaaaattagccaggcgtgatggcgggcgcctgtagtcccagctactcaggaggctgaggcaggagaatggggtgagcccgggaggcagagcttgcagtgagctgagattgcgccactgcactccagcctaggtgacagagcgagactctgtctcaaaataaaactaaaataaaatgggggccgggcacagtggctcatgtctgtaatcccagcactttgaaaggccgaggcaggcgaatcacctgaggtcaggagtttgagaccagcctgaccaacatggcgaaaccccgtctctactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtctcgaaaaaaaaaaataataaaatgggacctccacactgtggaggcccttgccagtctagagtggtgcttctttgcagggacttggaaacaaccccccaaacacagcatcccctcacacctgccacccacttccttaccggctgctgtgggagcctctatcctgaactatggaggggcggggtggaaattttatataaggaccttgttaaggccaagaaagtcagtttaatcttacaatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccactggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctt

SEQ ID NO: 376593 - DNA, 4689 bp, Homo sapiens
  misc_feature (14)..(14): n is a, c, g, or t
  misc_feature (22)..(22): n is a, c, g, or t
aagcggctggtacngtccgggnggtatgggatccgcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggtgagggttccaccgcccttccctgctcacctgtatgtctcctgccactcgcgttccccataaggtgtcaggaccagggctttgcactcctgcagcaagtgggccagtgaggattccccaccccgcccaggcccacccccaccccgtacttcccaggactgagggacaggctcggcctaaaaggtagatttcttccttctaggttttgtttcagttgaatacctgctaccatccatttgggtgcagttttttgttgaaaaaattttaatggccaataacttactgcattcaaagtgaggagttttataagggttttatttttaataagatgaatagtttaagcttcgtgtctagccctgcaccctcttagcctaacagcacacctcgagcgctgtgccctgggctgctgacgtggcggcaggccgctagcagcagtcggccacctcctgaggcgggcagcacaggcctgctgtggacactctaggtctggccttgtattttgtggtctcagaagcctttgtggggacttctagtgtagggaaggcagtctctctgggagctcctgcaatgccaaactcttagcccaggttcactcctccgatccaagcctggcaggggtggggcatcatggtgtgtaggtatcaggcaggacttgtaagccatcccgtcaagtcaaattctggcttaatgtgtctttaggtagatgacctctgagccacagtttcctattctatgaattggggtttagtaaatctctcgggactgagagccaatgaggccatgtgtgcacacaaaatgctgggcacaaatgaggggctcagcggggctgagaagtacatcccatccagtgccgacatccgcttgcatggtgccctggtaaccttgcctctgccctccccaggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcagatcacgaggtcaggagattgagaccatcctggctaacaggtgaaaccccgtctctacttaaaatacaaaaaaaaaaaaaattagccaggcgtgatggcgggcgcctgtagtcccagctactcaggaggctgaggcaggagaatggggtgagcccgggaggcagagcttgcagtgagctgagattgcgccactgcactccagcctaggtgacagagcgagactctgtctcaaaataaaactaaaataaaatgggggccgggcacagtggctcatgtctgtaatcccagcactttgaaaggccgaggcaggcgaatcacctgaggtcaggagtttgagaccagcctgaccaacatggcgaaaccccgtctctactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtctcgaaaaaaaaaaataataaaatgggacctccacactgtggaggcccttgccagtctagagtggtgcttctttgcagggacttggaaacaaccccccaaacacagcatcccctcacacctgccacccacttccttaccggctgctgtgggagcctctatcctgaactatggaggggcggggtggaaattttatataaggaccttgttaaggccaagaaagtcagtttaatcttacaatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccactggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctt

SEQ ID NO: 376594 - DNA, 1706 bp, Homo sapiens
  misc_feature (14)..(14): n is a, c, g, or t
  misc_feature (22)..(22): n is a, c, g, or t
aagcggctggtacngtccgggnggtatgggatccgcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcggattacctgaggtcaggagttcgagaccagcctggccaacatggtgaaaccctgtctctactaaaaatacaaaattagccagccatggtggtgcatgcctgtaatcccagctactcgggaggctgag

SEQ ID NO: 376595 - DNA, 1018 bp, Homo sapiens
  misc_feature (14)..(14): n is a, c, g, or t
  misc_feature (22)..(22): n is a, c, g, or t
aagcggctggtacngtccgggnggtatgggatccgcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactca

SEQ ID NO: 376596 - DNA, 3803 bp, Homo sapiens
ggccctggctgcctgggcgccgattcccgggacgcgccggccgacagcaggggaggcggcagcagggaccgcagcagcccccgcttccgcacggcccgccgggtcgcggagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcagatcacgaggtcaggagattgagaccatcctggctaacaggtgaaaccccgtctctacttaaaatacaaaaaaaaaaaaaattagccaggcgtgatggcgggcgcctgtagtcccagctactcaggaggctgaggcaggagaatggggtgagcccgggaggcagagcttgcagtgagctgagattgcgccactgcactccagcctaggtgacagagcgagactctgtctcaaaataaaactaaaataaaatgggggccgggcacagtggctcatgtctgtaatcccagcactttgaaaggccgaggcaggcgaatcacctgaggtcaggagtttgagaccagcctgaccaacatggcgaaaccccgtctctactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtctcgaaaaaaaaaaataataaaatgggacctccacactgtggaggcccttgccagtctagagtggtgcttctttgcagggacttggaaacaaccccccaaacacagcatcccctcacacctgccacccacttccttaccggctgctgtgggagcctctatcctgaactatggaggggcggggtggaaattttatataaggaccttgttaaggccaagaaagtcagtttaatcttacaatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccactggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctt

SEQ ID NO: 376597 - DNA, 3788 bp, Homo sapiens
  misc_feature (14)..(14): n is a, c, g, or t
  misc_feature (22)..(22): n is a, c, g, or t
aagcggctggtacngtccgggnggtatgggatccgcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcagatcacgaggtcaggagattgagaccatcctggctaacaggtgaaaccccgtctctacttaaaatacaaaaaaaaaaaaaattagccaggcgtgatggcgggcgcctgtagtcccagctactcaggaggctgaggcaggagaatggggtgagcccgggaggcagagcttgcagtgagctgagattgcgccactgcactccagcctaggtgacagagcgagactctgtctcaaaataaaactaaaataaaatgggggccgggcacagtggctcatgtctgtaatcccagcactttgaaaggccgaggcaggcgaatcacctgaggtcaggagtttgagaccagcctgaccaacatggcgaaaccccgtctctactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtctcgaaaaaaaaaaataataaaatgggacctccacactgtggaggcccttgccagtctagagtggtgcttctttgcagggacttggaaacaaccccccaaacacagcatcccctcacacctgccacccacttccttaccggctgctgtgggagcctctatcctgaactatggaggggcggggtggaaattttatataaggaccttgttaaggccaagaaagtcagtttaatcttacaatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccactggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctt

SEQ ID NO: 376598 - DNA, 3806 bp, Homo sapiens
ccccccccccccccccccccccaaaacggctaggacgaggcgggtgtgtgaatcggcagaggcttcatcttccccattcttcttctctcggtcccgggagccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcagatcacgaggtcaggagattgagaccatcctggctaacaggtgaaaccccgtctctacttaaaatacaaaaaaaaaaaaaattagccaggcgtgatggcgggcgcctgtagtcccagctactcaggaggctgaggcaggagaatggggtgagcccgggaggcagagcttgcagtgagctgagattgcgccactgcactccagcctaggtgacagagcgagactctgtctcaaaataaaactaaaataaaatgggggccgggcacagtggctcatgtctgtaatcccagcactttgaaaggccgaggcaggcgaatcacctgaggtcaggagtttgagaccagcctgaccaacatggcgaaaccccgtctctactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtctcgaaaaaaaaaaataataaaatgggacctccacactgtggaggcccttgccagtctagagtggtgcttctttgcagggacttggaaacaaccccccaaacacagcatcccctcacacctgccacccacttccttaccggctgctgtgggagcctctatcctgaactatggaggggcggggtggaaattttatataaggaccttgttaaggccaagaaagtcagtttaatcttacaatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccactggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctt

SEQ ID NO: 376599 - DNA, 3540 bp, Homo sapiens
ggaagggccgcacgtgcggtgacagggtccctctgataggttatatgcctctgcttttcaggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcagatcacgaggtcaggagattgagaccatcctggctaacaggtgaaaccccgtctctacttaaaatacaaaaaaaaaaaaaattagccaggcgtgatggcgggcgcctgtagtcccagctactcaggaggctgaggcaggagaatggggtgagcccgggaggcagagcttgcagtgagctgagattgcgccactgcactccagcctaggtgacagagcgagactctgtctcaaaataaaactaaaataaaatgggggccgggcacagtggctcatgtctgtaatcccagcactttgaaaggccgaggcaggcgaatcacctgaggtcaggagtttgagaccagcctgaccaacatggcgaaaccccgtctctactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtctcgaaaaaaaaaaataataaaatgggacctccacactgtggaggcccttgccagtctagagtggtgcttctttgcagggacttggaaacaaccccccaaacacagcatcccctcacacctgccacccacttccttaccggctgctgtgggagcctctatcctgaactatggaggggcggggtggaaattttatataaggaccttgttaaggccaagaaagtcagtttaatcttacaatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccactggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctt

SEQ ID NO: 376600 - DNA, 933 bp, Homo sapiens
  misc_feature (14)..(14): n is a, c, g, or t
  misc_feature (22)..(22): n is a, c, g, or t
aagcggctggtacngtccgggnggtatgggatccgcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactca

SEQ ID NO: 376601 - DNA, 1647 bp, Homo sapiens
  misc_feature (14)..(14): n is a, c, g, or t
  misc_feature (22)..(22): n is a, c, g, or t
aagcggctggtacngtccgggnggtatgggatccgcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggtgagggttccaccgcccttccctgctcacctgtatgtctcctgccactcgcgttccccataaggtgtcaggaccagggctttgcactcctgcagcaagtgggccagtgaggattccccaccccgcccaggcccacccccaccccgtacttcccaggactgagggacaggctcggcctaaaaggtagatttcttccttctaggttttgtttcagttgaatacctgctaccatccatttgggtgcagttttttgttgaaaaaattttaatggccaataacttactgcattcaaagtgaggagttttataagggttttatttttaataagatgaatagtttaagcttcgtgtctagccctgcaccctcttagcctaacagcacacctcgagcgctgtgccctgggctgctgacgtggcggcaggccgctagcagcagtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctt

SEQ ID NO: 376602 - DNA, 251 bp, Homo sapiens
aagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctttggtggtggccttgacgtctgcccctagaagagccat

SEQ ID NO: 376603 - DNA, 3852 bp, Homo sapiens
  misc_feature (14)..(14): n is a, c, g, or t
  misc_feature (22)..(22): n is a, c, g, or t
aagcggctggtacngtccgggnggtatgggatccgcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcagatcacgaggtcaggagattgagaccatcctggctaacaggtgaaaccccgtctctacttaaaatacaaaaaaaaaaaaaattagccaggcgtgatggcgggcgcctgtagtcccagctactcaggaggctgaggcaggagaatggggtgagcccgggaggcagagcttgcagtgagctgagattgcgccactgcactccagcctaggtgacagagcgagactctgtctcaaaataaaactaaaataaaatgggggccgggcacagtggctcatgtctgtaatcccagcactttgaaaggccgaggcaggcgaatcacctgaggtcaggagtttgagaccagcctgaccaacatggcgaaaccccgtctctactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtctcgaaaaaaaaaaataataaaatgggacctccacactgtggaggcccttgccagtctagagtggtgcttctttgcagggacttggaaacaaccccccaaacacagcatcccctcacacctgccacccacttccttaccggctgctgtgggagcctctatcctgaactatggaggggcggggtggaaattttatataaggaccttgttaaggccaagaaagtcagtttaatcttacaatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccactggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctt

SEQ ID NO: 376604 - DNA, 3613 bp, Homo sapiens
  misc_feature (14)..(14): n is a, c, g, or t
  misc_feature (22)..(22): n is a, c, g, or t
  misc_feature (3600)..(3600): n is a, c, g, or t
aagcggctggtacngtccgggnggtatgggatccgcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcagatcacgaggtcaggagattgagaccatcctggctaacaggtgaaaccccgtctctacttaaaatacaaaaaaaaaaaaaattagccaggcgtgatggcgggcgcctgtagtcccagctactcaggaggctgaggcaggagaatggggtgagcccgggaggcagagcttgcagtgagctgagattgcgccactgcactccagcctaggtgacagagcgagactctgtctcaaaataaaactaaaataaaatgggggccgggcacagtggctcatgtctgtaatcccagcactttgaaaggccgaggcaggcgaatcacctgaggtcaggagtttgagaccagcctgaccaacatggcgaaaccccgtctctactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtctcgaaaaaaaaaaataataaaatgggacctccacactgtggaggcccttgccagtctagagtggtgcttctttgcagggacttggaaacaaccccccaaacacagcatcccctcacacctgccacccacttccttaccggctgctgtgggagcctctatcctgaactatggaggggcggggtggaaattttatataaggaccttgttaaggccaagaaagtcagtttaatcttacaatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccactggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggacaggtgactcaaagaacctggccgacctcgccccatctttacatcgcgcncctcgtcctttag

SEQ ID NO: 376605 - DNA, 4901 bp, Homo sapiens
gcctcgtgccgctccgaggtgccccatgtgcggcaggaagaagcagcctccacaggactgcgctcagcgggagacggggcttccccgtgaagaggtgctgagtgcgaatgcccactccaacacctggtcactgtgtgatcttgagaaagagttgagcctctctgggccctggcttccccaacaaccaaaggctgtacagagagcggcttaggagagagctcctgtgtgcgccgccgagggctctgctggctcaggacatctgtaggaccagttccagctccagtgggcaccgccagcacgcccaggagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggtgagggttccaccgcccttccctgctcacctgtatgtctcctgccactcgcgttccccataaggtgtcaggaccagggctttgcactcctgcagcaagtgggccagtgaggattccccaccccgcccaggcccacccccaccccgtacttcccaggactgagggacaggctcggcctaaaaggtagatttcttccttctaggttttgtttcagttgaatacctgctaccatccatttgggtgcagttttttgttgaaaaaattttaatggccaataacttactgcattcaaagtgaggagttttataagggttttatttttaataagatgaatagtttaagcttcgtgtctagccctgcaccctcttagcctaacagcacacctcgagcgctgtgccctgggctgctgacgtggcggcaggccgctagcagcagtcggccacctcctgaggcgggcagcacaggcctgctgtggacactctaggtctggccttgtattttgtggtctcagaagcctttgtggggacttctagtgtagggaaggcagtctctctgggagctcctgcaatgccaaactcttagcccaggttcactcctccgatccaagcctggcaggggtggggcatcatggtgtgtaggtatcaggcaggacttgtaagccatcccgtcaagtcaaattctggcttaatgtgtctttaggtagatgacctctgagccacagtttcctattctatgaattggggtttagtaaatctctcgggactgagagccaatgaggccatgtgtgcacacaaaatgctgggcacaaatgaggggctcagcggggctgagaagtacatcccatccagtgccgacatccgcttgcatggtgccctggtaaccttgcctctgccctccccaggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcagatcacgaggtcaggagattgagaccatcctggctaacaggtgaaaccccgtctctacttaaaatacaaaaaaaaaaaaaattagccaggcgtgatggcgggcgcctgtagtcccagctactcaggaggctgaggcaggagaatggggtgagcccgggaggcagagcttgcagtgagctgagattgcgccactgcactccagcctaggtgacagagcgagactctgtctcaaaataaaactaaaataaaatgggggccgggcacagtggctcatgtctgtaatcccagcactttgaaaggccgaggcaggcgaatcacctgaggtcaggagtttgagaccagcctgaccaacatggcgaaaccccgtctctactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtctcgaaaaaaaaaaataataaaatgggacctccacactgtggaggcccttgccagtctagagtggtgcttctttgcagggacttggaaacaaccccccaaacacagcatcccctcacacctgccacccacttccttaccggctgctgtgggagcctctatcctgaactatggaggggcggggtggaaattttatataaggaccttgttaaggccaagaaagtcagtttaatcttacaatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccactggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctt

SEQ ID NO: 376606 - DNA, 3767 bp, Homo sapiens
  misc_feature (14)..(14): n is a, c, g, or t
  misc_feature (22)..(22): n is a, c, g, or t
aagcggctggtacngtccgggnggtatgggatccgcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcagatcacgaggtcaggagattgagaccatcctggctaacaggtgaaaccccgtctctacttaaaatacaaaaaaaaaaaaaattagccaggcgtgatggcgggcgcctgtagtcccagctactcaggaggctgaggcaggagaatggggtgagcccgggaggcagagcttgcagtgagctgagattgcgccactgcactccagcctaggtgacagagcgagactctgtctcaaaataaaactaaaataaaatgggggccgggcacagtggctcatgtctgtaatcccagcactttgaaaggccgaggcaggcgaatcacctgaggtcaggagtttgagaccagcctgaccaacatggcgaaaccccgtctctactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtctcgaaaaaaaaaaataataaaatgggacctccacactgtggaggcccttgccagtctagagtggtgcttctttgcagggacttggaaacaaccccccaaacacagcatcccctcacacctgccacccacttccttaccggctgctgtgggagcctctatcctgaactatggaggggcggggtggaaattttatataaggaccttgttaaggccaagaaagtcagtttaatcttacaatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccactggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctt

SEQ ID NO: 376607 - DNA, 3776 bp, Homo sapiens
gaatggttggacttttgtctgtaggattttcttagagtggtcaatgcccacctggtatcaggcactgggctaatggtgtacaaggtaatgtctctacccccaggaagctgcatgctgggagaggagacggatggagtccagcctggagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcagatcacgaggtcaggagattgagaccatcctggctaacaggtgaaaccccgtctctacttaaaatacaaaaaaaaaaaaaattagccaggcgtgatggcgggcgcctgtagtcccagctactcaggaggctgaggcaggagaatggggtgagcccgggaggcagagcttgcagtgagctgagattgcgccactgcactccagcctaggtgacagagcgagactctgtctcaaaataaaactaaaataaaatgggggccgggcacagtggctcatgtctgtaatcccagcactttgaaaggccgaggcaggcgaatcacctgaggtcaggagtttgagaccagcctgaccaacatggcgaaaccccgtctctactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtctcgaaaaaaaaaaataataaaatgggacctccacactgtggaggcccttgccagtctagagtggtgcttctttgcagggacttggaaacaaccccccaaacacagcatcccctcacacctgccacccacttccttaccggctgctgtgggagcctctatcctgaactatggaggggcggggtggaaattttatataaggaccttgttaaggccaagaaagtcagtttaatcttacaatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccactggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctt

SEQ ID NO: 376608 - DNA, 3915 bp, Homo sapiens
gcctcgtgccgctccgaggtgccccatgtgcggcaggaagaagcagcctccacaggactgcgctcagcgggagacggggcttccccgtgaagaggtgctgagtgcgaatgcccactccaacacctggtcactgtgtgatcttgagaaagagttgagcctctctgggccctggcttccccaacaaccaaaggctgtacagagagcggcttaggagagagctcctgtgtgcgccgccgagggctctgctggctcaggacatctgtaggaccagttccagctccagtgggcaccgccagcacgcccaggagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcagatcacgaggtcaggagattgagaccatcctggctaacaggtgaaaccccgtctctacttaaaatacaaaaaaaaaaaaaattagccaggcgtgatggcgggcgcctgtagtcccagctactcaggaggctgaggcaggagaatggggtgagcccgggaggcagagcttgcagtgagctgagattgcgccactgcactccagcctaggtgacagagcgagactctgtctcaaaataaaactaaaataaaatgggggccgggcacagtggctcatgtctgtaatcccagcactttgaaaggccgaggcaggcgaatcacctgaggtcaggagtttgagaccagcctgaccaacatggcgaaaccccgtctctactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtctcgaaaaaaaaaaataataaaatgggacctccacactgtggaggcccttgccagtctagagtggtgcttctttgcagggacttggaaacaaccccccaaacacagcatcccctcacacctgccacccacttccttaccggctgctgtgggagcctctatcctgaactatggaggggcggggtggaaattttatataaggaccttgttaaggccaagaaagtcagtttaatcttacaatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccactggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctt

SEQ ID NO: 376609 - DNA, 3793 bp, Homo sapiens
  misc_feature (14)..(14): n is a, c, g, or t
  misc_feature (22)..(22): n is a, c, g, or t
aagcggctggtacngtccgggnggtatgggatccgcgagctgtcgcgtctggtcgtggtctggcggagctgcggttggcttgtggcgtctccgccgccgccgccctcccttcctcttccccatcttcttctctcggtcccgggagcccccgcccggagtgagtagcgcgaggcggtgcgaagggagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaatcccagcactttgggaggccgaggcgggcagatcacgaggtcaggagattgagaccatcctggctaacaggtgaaaccccgtctctacttaaaatacaaaaaaaaaaaaaattagccaggcgtgatggcgggcgcctgtagtcccagctactcaggaggctgaggcaggagaatggggtgagcccgggaggcagagcttgcagtgagctgagattgcgccactgcactccagcctaggtgacagagcgagactctgtctcaaaataaaactaaaataaaatgggggccgggcacagtggctcatgtctgtaatcccagcactttgaaaggccgaggcaggcgaatcacctgaggtcaggagtttgagaccagcctgaccaacatggcgaaaccccgtctctactaaaaatacaaaaatcagccaggcatggtggtgggcacctataatgccagctactcaggaggctgaggcaggagaactgcttgaacctgggaggcagaggtcgcagtgagccgagattgcaccattgcactccagcctgggtgacagagtgtctcgaaaaaaaaaaataataaaatgggacctccacactgtggaggcccttgccagtctagagtggtgcttctttgcagggacttggaaacaaccccccaaacacagcatcccctcacacctgccacccacttccttaccggctgctgtgggagcctctatcctgaactatggaggggcggggtggaaattttatataaggaccttgttaaggccaagaaagtcagtttaatcttacaatataaatatatcatttagtcacctcagcttatccccagaggtgtttacacaattcccaatgaccagtgcagcttggaagggactgaggctcgcaagtgggtggcacagtcggctcttcagtggctccaaagtgagcccctcacaacaggagacacttcagagaggtctgtccccagccacgcactcatgattgctttttagcagaagtcatggtcgctgaggccctgggtttggcaaaagcacagctgccagcagagcacagttctggtaggtggggccacggctgacctggccccagagctacaggaacaggcaggggccagcttggcttgcaacaccatgaaacaagcctgtggggcccttagtgtcttctcccgcagagcccaccagaaacacttctgtgagtaacagaacctggaaggaaaaggggcaggggtggggccttggtggcaccgcacaggacgtgccccaggcttcctctccagctgcactgccacgtgcggccaacaagagccccgcagccctggggtgctgaggcttggtccttcccagcttctgcaaatgccctggcactgccctccaattcagagggtataaacatcaatccaagccctgttcctctttccaacatgggggggacttggagtgccactggagggaagggggcagtctctctggaagaaccagagctgcacccttcaccactggagtgatcacagcttcaggctctacctggctggcttttctcatgaaggatcccgtctcatctcccagatcaaaaagaccctcttctaatgctgtcccagcatctaccaacaggctgacctgagctgcccgtgtcccccgttcctgtagcctgagacctatcagatgtcatcttccacggagccactgtgctcgctaaggaggtaccacttcagcctgtcgggcagaggcagggctttgaccttcacatccacaggccacggctgaaggtagagccggatggccacacggcacaggtgcttgaggggcgggggatagctctccagctgcctcaaggagaagtggagggcctggatcttttccgccaggctgcccacagggtggatatcgaagttttcgggcagctggagtttctgagagttggtcaccatgagatccaggacagtctcagctttgcgcaggaggtccgcatggctctcgtcttccgtgcagcctgggtgggaacagagcctctcaaagatgatgtgaaagccagaccagcaggacgcaccgtgcagggagcagttgtaggcggctccggactccaggaggaagcgcaggagagggaagtgcagtttaaagctcttcaggcagatgtgggtgagggactcgtgggctgggcactcgctggggtcggccccgtgtgccagcagcagccgtgtgacttggaagcagaagcggttgatcatctgggcctcctctttgtcccctcccacggtctcaccaagcaggaagatgatgcaggtgaacactgtgtccccatctt

SEQ ID NO: 376610 - DNA, 1919 bp, Homo sapiens
  misc_feature (14)..(14): n is a, c, g, or t
  misc_feature (22)..(22): n is a, c, g, or t
aagcggctggtacngtccgggnggtatgggatccgcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggtgagggttccaccgcccttccctgctcacctgtatgtctcctgccactcgcgttccccataaggtgtcaggaccagggctttgcactcctgcagcaagtgggccagtgaggattccccaccccgcccaggcccacccccaccccgtacttcccaggactgagggacaggctcggcctaaaaggtagatttcttccttctaggttttgtttcagttgaatacctgctaccatccatttgggtgcagttttttgttgaaaaaattttaatggccaataacttactgcattcaaagtgaggagttttataagggttttatttttaataagatgaatagtttaagcttcgtgtctagccctgcaccctcttagcctaacagcacacctcgagcgctgtgccctgggctgctgacgtggcggcaggccgctagcagcagtcggccacctcctgaggcgggcagcacaggcctgctgtggacactctaggtctggccttgtattttgtggtctcagaagcctttgtggggacttctagtgtagggaaggcagtctctctgggagctcctgcaatgccaaactcttagcccaggttcactcctccgatccaagcctggcaggggtggggcatcatggtgtgtaggtatcaggcaggacttgtaagccatcccgtcaagtcaaattctggcttaatgtgtctttaggtagatgacctctgagccacagtttcctattctatgaattggggtttagtaaatctctcgggactgagagccaatgaggccatgtgtgcacacaaaatgctgggcacaaatgaggggctcagcggggctgagaagtacatcccatccagtgccgacatccgcttgcatggtgccctggtaaccttgcctctgccctccccaggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactca

SEQ ID NO: 376611 - DNA, 825 bp, Homo sapiens
  misc_feature (636)..(636): n is a, c, g, or t
aatgcgcagcctgagagggggtgagggacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagtcttcagagcatgggcntggcgcggtctacacactcaggggtcatcaggcagtttgggaggtgcccatgggtgaggagggttcgcccactcgggaaagaggcgggtgtgaaaggcccgggggtcccgcaggggccgctgatggccggtcccgaggaaaacgaaaccgaacgggcagggaacgacgaaaacacgggccaaagagagg

SEQ ID NO: 376612 - DNA, 931 bp, Homo sapiens
aatgcgcagcctgagagggggtgagggacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagtgagtgcagctacccgcccttcccagatctcgcctggacagagccaaccccgcccagccagggttggcccccctggaaaatccacctttcagaccagctcctaagaagcagtttcctgaaattgaatctctcctgctgtggtcccacccctccctctcttccacaatccaaaccttccctgaaggctctatgtgcttccttccctgccatataacccagttccttcccattccaatcctaggctcgataactccagcctcgttccaaccccacaccctacacccaaatcatattgagagtttctttgaggcaaagatcttggcatttctttgtatcttcttgagtccttcttaaaccagtgccttcttgatgaaaaaaaactctttgaatttaa

SEQ ID NO: 376613 - DNA, 836 bp, Homo sapiens
acagcaccttgttagtagaatcttttttattcagaaaaaaaaaaccccaaaaaacaaaagttttccaaccacacacgggagggatatgggtagggggaggtgtctgtccatccagccctggcccccagcccatgtggttttggcagcaataaggggtatggggtaatggcccaaaaaataaaatggtttgtgtgtgtatggggaggaaaggggtgcaaagctgtggggagcggtgaaggggaagggacagacgaggtcagtactgggaacgccgaaggtgggaggccatttcataacatttcttgttgatcaaaccaccgtggacaccttctttgcccatcagcaggactagcgtcttgtcagtcttggtgacagtgacattgaaggtgggggccccaccggtgctcttggtacgaagatccatgctaaattccccatcctgcagcagtgagtcccggatcaaggccggacccaccgccagccccggtaactcatcctacgagcctactcccaaagggggctaccagaaacgtggcctcccaggccccaaaagagcctccgggccatctctcagcctccgaagccagcaccagggctacatggggagccagcaagtctccatgggctacagccttacaacttgcggaatctcatgagcaccctccgaagccaaggatgggtctctggacaccccagagagccataagtggggggcaagcacgccatgttgccagcaattgcaccccctgtgggggcccgcaagaagagcccccggggcccagaaccgagggccagggccgcggcaaaggcacaaggccagtcatactcgagtgcag

SEQ ID NO: 376614 - DNA, 754 bp, Homo sapiens
acagcaccttgttagtagaatcttttttattcagaaaaaaaaaaccccaaaaaacaaaagttttccaaccacacacgggagggatatgggtagggggaggtgtctgtccatccagccctggcccccagcccatgtggttttggcagcaataaggggtatggggtaatggcccaaaaaataaaatggtttgtgtgtgtatggggaggaaaggggtgcaaagctgtggggagcggtgaaggggaagggacagacgaggtcagtactgggaacgccgaaggtgggaggccatttcataacatttcttgttgatcaaaccaccgtggacaccttctttgcccatcagcaggactagcgtcttgtcagtcttggtgacagtgacattgaaggtgggggccccaccggtgctcttggtacgaagatccatgctaaattccccatcctgcagcagtgagtcccggatcaccgaacatttctggcccccaagtgtcagcccattcacgtaaaaacttgaccgcccggggacggcggcccagacggagggcgagtccttgtagcccacgatggccgcgtcctgacaggtcccgtccgccatgaggttgtcgatgtaggcgttccacccggccatggcgctgctactggggctgctctcggcgctgctgctggggccgcggactgggctcgagctgcctcggctggcgggcggggggaggcggagagctcggggcacgcgctgccgtccggaccgcggctccgc

SEQ ID NO: 376615 - DNA, 259 bp, Homo sapiens
cttccaacgtggaaccagagctggaagctaggagaagcaggagtctctctctgcactgcctcctgtccctgagctcagagaggacacctcagccctttgagaggccgattccgagcagctgtgcccagtggggcttccacgggtatctatgaggctctggaaagtttctttgaggcaaagatcttggcatttctttgtatcttcttgagtccttcttaaaccagtgccttcttgatgaaaaaaaactctttgaatttaa

SEQ ID NO: 376616 - DNA, 2022 bp, Homo sapiens
acagcaccttgttagtagaatcttttttattcagaaaaaaaaaaccccaaaaaacaaaagttttccaaccacacacgggagggatatgggtagggggaggtgtctgtccatccagccctggcccccagcccatgtggttttggcagcaataaggggtatggggtaatggcccaaaaaataaaatggtttgtgtgtgtatggggaggaaaggggtgcaaagctgtggggagcggtgaaggggaagggacagacgaggtcagtactgggaacgccgaaggtgggaggccatttcataacatttcttgttgatcaaaccaccgtggacaccttctttgcccatcagcaggactagcgtcttgtcagtcttggtgacagtgacattgaaggtgggggccccaccggtgctcttggtacgaagatccatgctaaattccccatcctgcagcagtgagtcccggatcaccgaacatttctggcccccaagtgtcagcccattcacgtaaaaacttgaccggtctttgccaaccaggacacccacctcagctggcgtgatgttgacgaacgttttcccggggacggcggcccagacggagggcgagtccttgtagcccacgatggccgcgtcctgacagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccactttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376617 - DNA, 1646 bp, Homo sapiens
cgggcaactgagggacccactcacgtgcagccgccattcgcgccgcttccagggcaagcacccagtcagggcctctcgctgcgcgccctagaccgcgcccgcccccacccaagtccctccctcagggtccaaaccggagcagtgccccggaccgcgcaggcctcgcagtaccgtgatgttgacgaacgttttcccggggacggcggcccagacggagggcgagtccttgtagcccacgatggccgcgtcctgacagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccactttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376618 - DNA, 1522 bp, Homo sapiens
aatgcgcagcctgagagggggtgagggacactgtcccagctgccacctagactcggagctccatccaaacctccagcgaagacatcccaggttgggtgaatcttccagccctgggggtggaggtagtaaaggccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccactttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376619 - DNA, 1817 bp, Homo sapiens
aatgcgcagcctgagagggggtgagggacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctggtgaggcgttcgggtgtcccagtgttcctgcccgaatcccgtgcagctgcctaatatactgatttcagtgacctgctttgccatcgacttggatccttccaattcttagccccattaaaatccccatttaagctcttctgccctgtcacccctccatgaggctccttctgacctctagccgtgtctctgccctgtctctgccttgtctctgccctgtctctgctctgtctctgccctgtctctgccctgtctctgccctgtctctgccctgtctctgccctgtctctgccctgtctctgctctgtctctgccctgtctctgctccaaaccccaccagtggtctccatcgaagacccctttgaccaggatgactgggccactttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376620 - DNA, 1470 bp, Homo sapiens
taactcatcccggcgctggctggcctggagagggtaggatggggcggcgccgagaatggccgttatgaggaccctaagagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccactttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376621 - DNA, 1609 bp, Homo sapiens
aatgcgcagcctgagagggggtgagggacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccactttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaaaaaatgaatatgattaaatattcttgagggggggcccggtacccaattccccctaataggagtcgtttaaaaataaattggccgtcgttttttacacgtccgtgactgggaaaaaccactgccgtaacc

SEQ ID NO: 376622 - DNA, 1910 bp, Homo sapiens
aatgcgcagcctgagagggggtgagggacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccactttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgagtgcctcctgaccctgaggctcaccatagcctgcctctgccccagctctgcccactccagctacagtcttacccaccaactccaagcttacctttcccctggcacctgacttacccacaccttgatctcaagactttgtttgactaatccttggcctgactccaagagctttgcccctgtggctctgtcatgaccccccacccccagcccacaccattcctctctcagattccgctgttctcagcagcatctcaagagcccgaaatcaagataagtcttttcctctcctacttcccaaagaacttagtcactgccctccctgcagagtgcttgctacccaaaacagaagggagaggccccacccaacccctgctttcccactgagggaggttctagaaggccacatcaaatgtcctctccactcaggtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376623 - DNA, 1629 bp, Homo sapiens
aatgcgcagcctgagagggggtgagggacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccactttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacaggtacttgtagcttctctctactgagtgtctcaccaagttttcttggggtccctggcctcctgcctttgaggttaatgctcccttggggccaggtccaacccctcctttccagcctcacctaaccctccaaattcttcttccctcatcagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376624 - DNA, 1524 bp, Homo sapiens
aatgcgcagcctgagagggggtgagggacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaaaaaatgaatatgattaaatattcttgagggggggcccggtacccaattccccctaataggagtcgtttaaaaataaattggccgtcgttttttacacgtccgtgactgggaaaaaccactgccgtaacc

SEQ ID NO: 376625 - DNA, 824 bp, Homo sapiens
acagcaccttgttagtagaatcttttttattcagaaaaaaaaaaccccaaaaaacaaaagttttccaaccacacacgggagggatatgggtagggggaggtgtctgtccatccagccctggcccccagcccatgtggttttggcagcaataaggggtatggggtaatggcccaaaaaataaaatggtttgtgtgtgtatggggaggaaaggggtgcaaagctgtggggagcggtgaaggggaagggacagacgaggtcagtactgggaacgccgaaggtgggaggccatttcataacatttcttgttgatcaaaccaccgtggacaccttctttgcccatcagcaggactagcgtcttgtcagtcttggtgacagtgacattgaaggtgggggccccaccggtgctcttggtacgaagatccatgctaaattccccatcctgcagcagtgagtcccggatcaccgaacatttctggcccccaagtgtcagcccattcacgtaaaaacttgaccggtctttgccaaccaggacacccacctcagctggctggaagaggaaccaagcgcccatcaagttagtcagtgcaccaagattcccaccgtgttctccaaagacccacctgtcttccacttctgagaaccaccccgccgtgggggctaagtataaattatatactcagtacacatcaatgaactgtgagaaactctgaggactgtgggacgttagtgcagaaaaagatcatgattctgaaacttagaatatggaaccagggaggaagggatgacatactcctctagagatttagatgtcagtgttaatgggg

SEQ ID NO: 376626 - DNA, 794 bp, Homo sapiens
aatgcgcagcctgagagggggtgagggacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaagggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376627 - DNA, 929 bp, Homo sapiens
aatgcgcagcctgagagggggtgagggacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggttgggccctggttcttcgcggaggcggtggtcctcgtgggcacgccgggcacgggagcggacgcttgcttggaccctggccgacttgcggggcgggcacctggg

SEQ ID NO: 376628 - DNA, 368 bp, Homo sapiens
attctgactgctgtgtgaggcaccagacggctcggtgccgaacgaccagtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376629 - DNA, 808 bp, Homo sapiens
acagcaccttgttagtagaatcttttttattcagaaaaaaaaaaccccaaaaaacaaaagttttccaaccacacacgggagggatatgggtagggggaggtgtctgtccatccagccctggcccccagcccatgtggttttggcagcaataaggggtatggggtaatggcccaaaaaataaaatggtttgtgtgtgtatggggaggaaaggggtgcaaagctgtggggagcggtgaaggggaagggacagacgaggtcagtactgggaacgccgaaggtgggaggccatttcataacatttcttgttgatcaaaccaccgtggacaccttctttgcccatcagcaggactagcgtcttgtcagtcttggtgacagtgacattgaaggtgggggccccaccggtgctcttggtacgaagatccatgctaaattccccatcctgcagcagtgagtcccggatcaccgaacatttctggcccccaagtgtcagcccattcacgtaaaaacttgaccggtctttgccaaccaggacacccacctcagctggcgtgatgttgacgaacgttttcccggggacggcggcccagacggagggcgagtccttgtagcccacgatggccgcgtcctgacaggtcccgtccgccatgaggttgtcgatgtaggcgttccacccggccatggcgctgctactggggctgctctcggcgctgctgctggggccgcggactgggctcgagctgcctcggctggcgggcggggggaggcggagagctcggggcacgcgctgccgtccggaccgcggctccgc

SEQ ID NO: 376630 - DNA, 1480 bp, Homo sapiens
aatgcgcagcctgagagggggtgagggacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccactttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376631 - DNA, 1797 bp, Homo sapiens
aatgcgcagcctgagagggggtgagggacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctggtgaggcgttcgggtgtcccagtgttcctgcccgaatcccgtgcagctgcctaatatactgatttcagtgacctgctttgccatcgacttggatccttccaattcttagccccattaaaatccccatttaagctcttctgccctgtcacccctccatgaggctccttctgacctctagccgtgtctctgccctgtctctgccttctgtctctgccctgtctctgccctgtctctgccctgtctctgccctgtctctgccctgtctctgccctgtctctgctctgtctctgccctgtctctgctccaaaccccaccagtggtctccatcgaagacccctttgaccaggatgactgggccactttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376632 - DNA, 1367 bp, Homo sapiens
aatgcgcagcctgagagggggtgagggacactgtcccagctgccacctagactcggagctccatccaaacctccagcgaagacatcccaggttgggtgaatcttccagccctgggggtggaggtagtaaaggccatggccatgcagaaaatctttgcccgggaaatcttggactccaggggcaaccccacggtggaggtggacctgcacacggccaaggaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccactttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376633 - DNA, 1351 bp, Homo sapiens
aatgcgcagcctgagagggggtgagggacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaagccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccactttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376634 - DNA, 2059 bp, Homo sapiens
aatgcgcagcctgagagggggtgagggacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccactttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgagtgcctcctgaccctgaggctcaccatagcctgcctctgccccagctctgcccactccagctacagtcttacccaccaactccaagcttacctttcccctggcacctgacttacccacaccttgatctcaagactttgtttgactaatccttggcctgactccaagagctttgcccctgtggctctgtcatgaccccccacccccagcccacaccattcctctctcagattccgctgttctcagcagcatctcaagagcccgaaatcaagataagtcttttcctctcctacttcccaaagaacttagtcactgccctccctgcagagtgcttgctacccaaaacagaagggagaggccccacccaacccctgctttcccactgagggaggttctagaaggccacatcaaatgtcctctccactcaggtgcaaactggctcagtctaatggctggggggtgatggtgagccaccgctctggggagactgaggacacattcattgctgaccttgtggtggggctctgcacaggacaggtacttgtagcttctctctactgagtgtctcaccaagttttcttggggtccctggcctcctgcctttgaggttaatgctcccttggggccaggtccaacccctcctttccagcctcacctaaccctccaaattcttcttccctcatcagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376635 - DNA, 428 bp, Homo sapiens
gttatgattgagctagatgggaccgagaataagtccaagtttggggccaatgccatccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaa

SEQ ID NO: 376636 - DNA, 2414 bp, Homo sapiens
cctgttctcgcgggatctaaaggcgggactgccacgtccaagcaaaccgggaaaggagaggatcccggagccggtgagaattctctgttttttctctaccatcctttccaggccttttcctcacctaatgagtcgtagagacgagggcccagagagtctgtaaagtggctggtgaaagattagtgtcccagggccctacatccgggaggtggttcgggataaagagaactagtcttgggaacaatgtaggtgggaacttaagggaatgggagagcggcccatagaggtggacggagggcgcgattggagtaaagcggaccctgtgtaggtatagagttgagtcaagtggagtcactgcctctgtccctctggtcagcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccca

SEQ ID NO: 376637 - DNA, 2154 bp, Homo sapiens
  misc_feature (2141)..(2141): n is a, c, g, or t
cctgttctcgcgggatctaaaggcgggactgccacgtccaagcaaaccgggaaaggagaggatcccggagccgcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgccccaaaaaaaaaaaaaaaaaaaaaaaaaaaaagnaaaagaaaaagaa

SEQ ID NO: 376638 - DNA, 2131 bp, Homo sapiens
cctgttctcgcgggatctaaaggcgggactgccacgtccaagcaaaccgggaaaggagaggatcccggagccgcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatggggagcaagatgcgccatcttctcccatcagagtataatcatgttcatttcagtttacaatccttgcagtcccatcgatttgtgagattatacccaggtcatccacagtggaggtctgaaaatgttcttagttgtactctaatttcactaactgatgggacgaagactg

SEQ ID NO: 376639 - DNA, 2033 bp, Homo sapiens
tgcgccctgggattgccgttgtagatctgctaagcacagggtgaacgtattggcttctgctgtctggactcaggggtgttgtagatcgagagagataccgaggcgtcgacttcataatcttgatcatcactgttatcagtgctagtcaaaatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccca

SEQ ID NO: 376640 - DNA, 2314 bp, Homo sapiens
cctgttctcgcgggatctaaaggcgggactgccacgtccaagcaaaccgggaaaggagaggatcccggagccggtgagaattctctgttttttctctaccatcctttccaggccttttcctcacctaatgagtcgtagagacgagggcccagagagtctgtaaagtggctggtgaaagattagtgtcccagggccctacatccgggaggtggttcgggataaagagaactagtcttgggaacaatgtaggtgggaacttaagggaatgggagagcggcccatagaggtggacggagggcgcgattggagtaaagcggaccctgtgtaggtatagagttgagtcaagtggagtcactgcctctgtccctctggtcagcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacaggcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccca

SEQ ID NO: 376641 - DNA, 1464 bp, Homo sapiens
cggtgactctacaggatcccggacatttcacgagtcgccccggacatggacactcccacaggtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccca

SEQ ID NO: 376642 - DNA, 1485 bp, Homo sapiens
cctgttctcgcgggatctaaaggcgggactgccacgtccaagcaaaccgggaaaggagaggatcccggagccggtgagaattctctgttttttctctaccatcctttccaggccttttcctcacctaatgagtcgtagagacgagggcccagagagtctgtaaagtggctggtgaaagattagtgtcccagggccctacatccgggaggtggttcgggataaagagaactagtcttgggaacaatgtaggtgggaacttaagggaatgggagagcggcccatagaggtggacggagggcgcgattggagtaaagcggaccctgtgtaggtatagagttgagtcaagtggagtcactgcctctgtccctctggtcagcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtctgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccca

SEQ ID NO: 376643 - DNA, 1182 bp, Homo sapiens
  misc_feature (766)..(766): n is a, c, g, or t
  misc_feature (772)..(772): n is a, c, g, or t
cctgttctcgcgggatctaaaggcgggactgccacgtccaagcaaaccgggaaaggagaggatcccggagccgcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtgccagggccccattctgtctgtgtgatcgtggggccctggccactgtgggagtttncatgtnctgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccca

SEQ ID NO: 376644 - DNA, 526 bp, Homo sapiens
cagcctctgtaagactgccagcccttgaaggccctaatgccaaagtaaccattctcccaggctacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccca

SEQ ID NO: 376645 - DNA, 2111 bp, Homo sapiens
cctgttctcgcgggatctaaaggcgggactgccacgtccaagcaaaccgggaaaggagaggatcccggagccgcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccca

SEQ ID NO: 376646 - DNA, 2114 bp, Homo sapiens
cctgttctcgcgggatctaaaggcgggactgccacgtccaagcaaaccgggaaaggagaggatcccggagccgcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggataattcttttcctgtacctatttatgttattacaggttctctgtctcgacaccgtgtttatactgatcatgatgtatgcttcatttatgcttccatttattattccttccccttatcttgaagattatttgtga

SEQ ID NO: 376647 - DNA, 1809 bp, Homo sapiens
tgtgtagtgttctagaggatcacccagatccgtcgactgagccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccca

SEQ ID NO: 376648 - DNA, 1878 bp, Homo sapiens
attatacaattgagggagggcggtaagcagggaggtgtaagatatgttcttggagactactttgtctaccagaatctgtgaagcactcctttagtgttgaatgaggaatttaggcatgattggcctttgttgctgcccatcatggtgacgtggggtaggaggtacctcctaccccacgtgtttccttttcttcttcctctgagctctgcttctccttggtagaacgctcttgtcttccatgtccatgacttccacgtgtatgactgtgagcgtgtccatgtccatgactgtgaccatgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccca

SEQ ID NO: 376649 - DNA, 1043 bp, Homo sapiens
  misc_feature (1032)..(1032): n is a, c, g, or t
cctgttctcgcgggatctaaaggcgggactgccacgtccaagcaaaccgggaaaggagaggatcccggagccgcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagaggaagagagtcattttttaatgtattttcgaggtagaactgacaggactggtttatggattggatgttggnagagagacggg

SEQ ID NO: 376650 - DNA, 1485 bp, Homo sapiens
  misc_feature (1069)..(1069): n is a, c, g, or t
  misc_feature (1075)..(1075): n is a, c, g, or t
cctgttctcgcgggatctaaaggcgggactgccacgtccaagcaaaccgggaaaggagaggatcccggagccggtgagaattctctgttttttctctaccatcctttccaggccttttcctcacctaatgagtcgtagagacgagggcccagagagtctgtaaagtggctggtgaaagattagtgtcccagggccctacatccgggaggtggttcgggataaagagaactagtcttgggaacaatgtaggtgggaacttaagggaatgggagagcggcccatagaggtggacggagggcgcgattggagtaaagcggaccctgtgtaggtatagagttgagtcaagtggagtcactgcctctgtccctctggtcagcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtgccagggccccattctgtctgtgtgatcgtggggccctggccactgtgggagtttncatgtnctgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccca

SEQ ID NO: 376651 - DNA, 1134 bp, Homo sapiens
ccccaccgactctcaggtctggaccagctcccctgaacgccaaggcttcaaggaaacaccaggatcccatatttcaggaccatctctccccggggctgctgtgcaaattaagcaagtcttaaagtggcctgtcctcttcaaagcaaagcctcctgaatttcaagcaatcatttcggaaagagactgctaagcacatgtgatgcaccttacagagaaatggcactaccagatttggaaaggctgcatgtgcgtgaggaaagattagcaaggatttcatctctgcccttaaatcaccaaagaaaacccaccatccccgcaattctcgaggcaggttgctggccacagtgagaagaccttggtggcacgttacacggtgaaatacaatcctcaccacattaaacatggatgtccccaaacctggaaggaacctcccagcttgcctcttcagtgactgtcaaccctggctgacatcagaaccgcctgggacatggagaaacctgtatgagttggtgtctcaggcctggcggctcagcacactgcctgggtgagagctcctcaggtgattcgactgtgtccccagggcagagagccactacatcatccagcatggagacgtgaggacatccaggctcccagagctcagcctacagtcggagcacactgtgtgctcagggcaggtgtttttctggcgcactctctgcctttcccacttgtggtcagttcaagcccccaccagccacacatgggctaatggtgctaagtggcatccccactcctctttccagaaagctgcttgtttgggcaagaagagagatgccccgtgatgccgaagagcaagttatggtggaggcctgagcatgagagctctggtcacaccacgccgaggaccggacggtgcccttgcttcctgtgagtggtctcttcgctttctggctggaacgataaccccaggggttgtgaggacagaacctccacctgccatccccatgggcaccgctggtctccagagcacgtcaaggtccttcccctcccagcttctgatcttggagagcgaggcctctcatgctcacatgcatgtgtttaggtgtatatgctgccatgccatgctttaaaaataaaaagtgttttgaataa

SEQ ID NO: 376652 - DNA, 530 bp, Homo sapiens
tctgacccaagaattaaggaaatgatttcagtgtttatataaacaaatagaatcctcaaacctatagaaccgatgtgttcagtgttgtcacctttgtttagtatatagttgctcagataatgtttattatatttattttgtgtatttttgttaaaagtataaaagcagacctggttctaatcctagctccatctttttatctctgtgaccctaaacaggttacttaatgcctcaaaaaaaatatttagatagccaggagtggtagcttacgcctgcagtcctggcactttgtgaggccaaggcaggtagattgcttgagcctgggagttcaagaccagtcggcaacctggcgaaaccccagctctataaaaatcagccagacatggtggcacatgcctgtagccccagctactcaggaagctgaggtaggaggatagtgtgagcccaggacaccatggttgctggggctgtgatcacgccactgcactccagcctgagaggcaagcaagactctgtctcaaaagacagac

SEQ ID NO: 376653 - DNA, 2342 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaa

SEQ ID NO: 376654 - DNA, 487 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtgaggggcggcggggcctgcggaggcgtcggaacccggggccccgcgggccgcccttccgccgcgcccggagcccgcggccgggcacgggtcgaggcggccgc

SEQ ID NO: 376655 - DNA, 2345 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaa

SEQ ID NO: 376656 - DNA, 2885 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccatcaataaaaaaaacaacaaaacaaaaaaaacaaacaaatcacacacaaaaaaaaagaagaggggggggcgcgaaaaaaacaatcaccgcgggggggccaacaaacaacccaaccacatattttataagaaaagcaagcgcagccccataatagatgcattataaacaaactaacaacgaaccaagcccgacgagcgccgcaaaaaacacatgccctgcatagagaaacacaaccacacccactcctcagtaattctaagcaaacaacaaccccaccttctagggggaggagacagatataagacaacaaccacccacagaaagaatctgccgccgccagaaaaataaacaagcagaggagtagtgagaaccaccaacgccaacgtctgccagccaaagaaacccctgacgagagaatgaaaacaaacacaagcgcgagacataacaggagag

SEQ ID NO: 376657 - DNA, 2657 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaaaaaaaaaaaaaaaaaaaaaaaaaaaaaaaaaaaaaaggggggggcgcaaaaaattccccccgggggcgcccagcgttttacgccgtgttcacccaagggtcttctttgttttaccaagggtggcgcccccataataggggagacgcctcgtatttaatatagtccgaaggcggcccgctgggcgccgccggttttacacaacggtctcgtcgacgtgggaagaaccctggcctacgttggcgaacccgttgtggggaagagagaaccccttacttctcgggcgggggcgccacattcggggcacaactcactcca

SEQ ID NO: 376658 - DNA, 2889 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaaaaaaaaaaaaaaaaaaaaaaaaaaaaaaaaaaaaaaaaaaaaaaaaaaaaaaaaaaaaaaaaaaaaaaattaactggcgaaagttaaaaaagatacgcaatgggaaaaaccttgattttaccaaacttattaaacttaggaaaaacccccttatgcccgttcgaataaaactcaaaagcccctaccgaatgaacattcaaaaggtaaattaaactggatggcaaaagggtaaatttaaaggaaaaaaatatggtaaaaatccacataaaatactgtttagaaaattcttttttaaaaccataaagccaaaaaggataaaaccctttatggtaaataggttaaaccgttttaggcttgaagcaattatcatttaggaacagaggccccttaaaagggactaaacttctaacctagagggtggaaaaccccttaattagggaagaggccaaatattgaagcgctccgctgaaaaaatttttgagtttaaggctccaaagaacctttatttaaactttaatgggcccccctttctttggagaggcggtct

SEQ ID NO: 376659 - DNA, 1777 bp, Homo sapiens
ctgctccgccctctctgctgctccccccctctctgctgctccgcccctctctggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaa

SEQ ID NO: 376660 - DNA, 2363 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaacctgggtgtcagacaaacctt

SEQ ID NO: 376661 - DNA, 2373 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaattttaatttatttccccccaatctttccctt

SEQ ID NO: 376662 - DNA, 2286 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcataatcctcggacgttgcta

SEQ ID NO: 376663 - DNA, 1640 bp, Homo sapiens
  misc_feature (15)..(15): n is a, c, g, or t
atttcgcattcgagnctcggtaccccaagcagttaatacagactcacggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaa

SEQ ID NO: 376664 - DNA, 1625 bp, Homo sapiens
  misc_feature (22)..(22): n is a, c, g, or t
  misc_feature (27)..(27): n is a, c, g, or t
ctccgtaacccagcacggttanacagnctcacggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaa

SEQ ID NO: 376665 - DNA, 2000 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaa

SEQ ID NO: 376666 - DNA, 1757 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgcccccccctctgtgctgtccagcctcttgtgctgtccagccccctgtgtcctcctctgtgctgt

SEQ ID NO: 376667 - DNA, 1925 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaa

SEQ ID NO: 376668 - DNA, 1281 bp, Homo sapiens
ctccctgccgtgttgctcttctgctcctccttcatccctgtgtcagtgggatggtctcctgaggaagcctctgccttggccttgttctcctcctcagccagcctctcaagcatattggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaa

SEQ ID NO: 376669 - DNA, 1581 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctcttctctgcacgttgctgaaggtccaggcttgcctcaagttccatgcttgagcaataaagtggaaacaataaaa

SEQ ID NO: 376670 - DNA, 1353 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaacagacaagaacacacgccagccaagaacacaggt

SEQ ID NO: 376671 - DNA, 1312 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctggataccgggaactctagtcacc

SEQ ID NO: 376672 - DNA, 1219 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctgtaataactgcttgggtccactatttcct

SEQ ID NO: 376673 - DNA, 1219 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaaaaaaaaaaaaaaaaaaaaaaaaaaaaaaaaaaaaaaaaaaaaaaaaaaaaaaaaaaaaaaaaaaaaaaattaactggcgaaagttaaaaaagatacgcaatgggaaaaaccttgattttaccaaacttattaaacttaggaaaaacccccttatgcccgttcgaataaaactcaaaagcccctaccgaatgaacattcaaaaggtaaattaaactggatggcaaaagggtaaatttaaaggaaaaaaatatggtaaaaatccacataaaatactgtttagaaaattcttttttaaaaccataaagccaaaaaggataaaaccctttatggtaaataggttaaaccgttttaggcttgaagcaattatcatttaggaacagaggccccttaaaagggactaaacttctaacctagagggtggaaaaccccttaattagggaagaggccaaatattgaagcgctccgctgaaaaaatttttgagtttaaggctccaaagaacctttatttaaactttaatgggcccccctttctttggagaggcggtct

SEQ ID NO: 376674 - DNA, 729 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaagattattggggacctcaagcgtctgctccagcggctctcctgtggcatgtgacttccccttctcgctccagcgtcctgccgttttctacgagattgttattcaggtcatcaagagagagggcacaggtacagagatgcccatgattggggaccgagtctttgtccactacactggctggctattagatggcacaaagtttgactccagtctggatcgcaaggacaaattctcctttgacctgggaaaaggaggggaggtcatcaaggcttgggacattgccatagccaccatgaaggtgggggaggtagcactctgtttgtggagtagcactgacgactcctctaga

SEQ ID NO: 376675 - DNA, 1020 bp, Homo sapiens
cccagcggagctgccagccgcgggccgcctcgttggtggcggtgccagggctcgcccacccgggcggtggaacacgggccaggacggggagcgactccccacagtgctttcctggcccttcggcctttgtgcgacgcaggcgcgacagggttccggcgccctcccggggtcccctgccgacgccgggacccagcgaggtccccactcgccgcgcggcgccccctccctcggccccggggaggccgggcgcggggcatgccgggagctgtagtcccctcccccctccgccgcctcccggagccagggctgcggggtgtggggcggggaggaggcgctctgctgtggagcctgccgccgagtgaccgctcgactacaaatagcctggggagctgcggggagggcatcttgacctgggccaggacaacctgccttgggtcggagcaggttccagggagaatcagagatggtgaattcccagcctgcgtcttatgccttctccccatccgctgctgcgtcctcatcctggcttcccaccgctgagctccgcgtgtgcggcacccacctcagggggcctttacctggtccagaagtgcatctgtctttgcaccagattattggggacctcaagcgtctgctccagcggctctcctgtggcatgtgacttccccttctcgctccagcgtcctgccgttttctacgagattgttattccaggaaagctcatttcccctttgatccatcattccttcccttttacctttctactcctcaaagcccctgtctattcttcgtggaagctttcccttggagggtaaccacacacctaccaggtggcgctaaagaagcctttacgtttctgggaaatactccagccctggactaactaccagaggaatactcagctcccaagtcagagtttaaggtcccatggagagcctccgggttcacctataacctggtttcttccttacctgttttgaactgtttctattctcttcactcatactcctctcgctctcc

SEQ ID NO: 376676 - DNA, 2445 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaagattattggggacctcaagcgtctgctccagcggctctcctgtggcatgtgacttccccttctcgctccagcgtcctgccgttttctacgagattgttattcaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaa

SEQ ID NO: 376677 - DNA, 2243 bp, Homo sapiens
caaaccagaccttagtctgacgaccactggcatgaaggaagaaggaggaagtgtggcataaatacttccccctttgccgattataataataatctattattcaaccttttactggtctaatcttccaacaactgtaggagatagggattatcatcactgctttacaaataaagtgtggagaattttaaaaacttaccatacagcggaaacttgaactcagatctctcagccttttgtctcctttttcaaaccaagtcttgctgcacctcaagaaagacaagaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaa

SEQ ID NO: 376678 - DNA, 2603 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggagggtgagacagtacagtctgggctttcaattctcattctgatatttaggccttgtgtggctttgggcaagacacttccgttctccgagcctatcttcttgtccataaaatgaggggttggaccatattctcttcatatcactccagatttgagaacacaggagaatcttgggatgatgggggtgatgcagggaggctgatggcatccttcctcagtcacctgccctcttacaactctggtacactgcctctctttcatgccagttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaa

SEQ ID NO: 376679 - DNA, 2360 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctcctcctcgccccacacctcccagctcccctgggcgtcctgtggcttgcctggatggaaggagacttaggaacctgccagttggccatgatgtctttttttctttttctttttttttacacaacagaacgaaaccaaaaaatgtccagaaaaaaaaaa

SEQ ID NO: 376680 - DNA, 1901 bp, Homo sapiens
  misc_feature (15)..(15): n is a, c, g, or t
atttcgcattcgagnctcggtaccccaagcagttaatacagactcacggtgaaggctatgctaagcccaatgagggtgctatcgtggagggtgagacagtacagtctgggctttcaattctcattctgatatttaggccttgtgtggctttgggcaagacacttccgttctccgagcctatcttcttgtccataaaatgaggggttggaccatattctcttcatatcactccagatttgagaacacaggagaatcttgggatgatgggggtgatgcagggaggctgatggcatccttcctcagtcacctgccctcttacaactctggtacactgcctctctttcatgccagttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaa

SEQ ID NO: 376681 - DNA, 1617 bp, Homo sapiens
  misc_feature (1583)..(1583): n is a, c, g, or t
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggccaaggcagaggcttcctcattggaaaaactngactcatattccagccaagacacgatcttcttat

SEQ ID NO: 376682 - DNA, 1448 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggccctagaactggacagcaacaacgagaagggcctcttccgccggggagaggcccacctggccgtgaatgactttgaactggcacgggctgatttccagaaggtcctgcgaacctaagagggagcctctagatgacca

SEQ ID NO: 376683 - DNA, 1220 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctgtattaactgcttggggatcctctaggtct

SEQ ID NO: 376684 - DNA, 1242 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgtttgagtttaagggagaagatctgacggaagaggaagatggcggaatcattcgcagaatacagactcgcggtgaaggctatgctaagcccaatgagggtgctatcgtggaggttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccagctatgcttttggcagtgttgggaaggaaaagttccaaatcccaccaaatgctgagctgaaatatgaattacacctcaagagttttgaaaaggccaaggagtcttgggagatgaattcagaagagaagctggaacagagcaccatagtgaaagagcggggcactgtgtacttcaaggaaggtaaatacaagcaagctttactacagtataagaagatcgtgtcttggctggaatatgagtctatagtttttccaaggggggctcactagggctcacaggaggctcacagttgct

SEQ ID NO: 376685 - DNA, 672 bp, Homo sapiens
tctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaa

SEQ ID NO: 376686 - DNA, 619 bp, Homo sapiens
tagggtaacggcggtgcaggggatgcctaaggccctacccccacccccagcactctcggctccatgtctgacccttccacgcctgtctcaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacaggtagggggccatgggtgtgtatgctgtgggcagagatgggtcttacctgtgtgtgtggggagttgtgcctgtattaaaggtgtggaactgaacatagacgtggtattgccgggtgcatgttcgtggacctgtgccactgtttcattgcatcagtgcccctcagaggttcccggtactgtatttggtggtctcccattgacagagcctcagggtccatctgcagagctttcctggtgtgcaactcttctcatcattgtggtgtgaacaacgtcaggggatactcaaggagacaaccagcaccaaagctacgatgcactgccct

SEQ ID NO: 376687 - DNA, 3662 bp, Homo sapiens
cggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccaggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggctctggttttgggaaaaaaagcaaagacatgtccacagagcgggacttcttcatgaggatgaagtgcacggtcaccaacagaggccgtactgtcaacctcaagtcagccacctggaaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacagaatcacagaactgattggttaccaccctgaggagctgcttggccgctcagcctatgaattctaccatgcgctagactccgagaacatgaccaagagtcaccagaacttgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcgggaatcagaacttcgaggagtcctcagcctatggcaaggccatcctgcccccgagccagccatgggccacggagttgaggagccacagcacccagagcgaggctgggagcctgcctgccttcaccgtgccccaggcagctgccccgggcagcaccacccccagtgccaccagcagcagcagcagctgctccacgcccaatagccctgaagactattacacatctttggataacgacctgaagattgaagtgattgagaagctcttcgccatggacacagaggccaaggaccaatgcagtacccagacggatttcaatgagctggacttggagacactggcaccctatatccccatggacggggaagacttccagctaagccccatctgccccgaggagcggctcttggcggagaacccacagtccaccccccagcactgcttcagtgccatgacaaacatcttccagccactggcccctgtagccccgcacagtcccttcctcctggacaagtttcagcagcagctggagagcaagaagacagagcccgagcaccggcccatgtcctccatcttctttgatgccggaagcaaagcatccctgccaccgtgctgtggccaggccagcacccctctctcttccatggggggcagatccaatacccagtggcccccagatccaccattacattttgggcccacaaagtgggccgtcggggatcagcgcacagagttcttgggagcagcgccgttggggccccctgtctctccaccccatgtctccaccttcaagacaaggtctgcaaagggttttggggctcgaggcccagacgtgctgagtccggccatggtagccctctccaacaagctgaagctgaagcgacagctggagtatgaagagcaagccttccaggacctgagcgggggggacccacctggtggcagcacctcacatttgatgtggaaacggatgaagaacctcaggggtgggagctgccctttgatgccggacaagccactgagcgcaaatgtacccaatgataagttcacccaaaaccccatgaggggcctgggccatcccctgagacatctgccgctgccacagcctccatctgccatcagtcccggggagaacagcaagagcaggttccccccacagtgctacgccacccagtaccaggactacagcctgtcgtcagcccacaaggtgtcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttttgtttaagctgactctt

SEQ ID NO: 376688 - DNA, 3618 bp, Homo sapiens
cggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccaggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggctctggttttgggaaaaaaagcaaagacatgtccacagagcgggacttcttcatgaggatgaagtgcacggtcaccaacagaggccgtactgtcaacctcaagtcagccacctggaaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacagaatcacagaactgattggttaccaccctgaggagctgcttggccgctcagcctatgaattctaccatgcgctagactccgagaacatgaccaagagtcaccagaacttgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcgggaatcagaacttcgaggagtcctcagcctatggcaaggccatcctgcccccgagccagccatgggccacggagttgaggagccacagcacccagagcgaggctgggagcctgcctgccttcaccgtgccccaggcagctgccccgggcagcaccacccccagtgccaccagcagcagcagcagctgctccacgcccaatagccctgaagactattacacatctttggataacgacctgaagattgaagtgattgagaagctcttcgccatggacacagaggccaaggaccaatgcagtacccagacggatttcaatgagctggacttggagacactggcaccctatatccccatggacggggaagacttccagctaagccccatctgccccgaggagcggctcttggcggagaacccacagtccaccccccagcactgcttcagtgccatgacaaacatcttccagccactggcccctgtagccccgcacagtcccttcctcctggacaagtttcagcagcagctggagagcaagaagacagagcccgagcaccggcccatgtcctccatcttctttgatgccggaagcaaagcatccctgccaccgtgctgtggccaggccagcacccctctctcttccatggggggcagatccaatacccagtggcccccagatccaccattacattttgggcccacaaagtgggccgtcggggatcagcgcacagagttcttgggagcagcgccgttggggccccctgtctctccaccccatgtctccaccttcaagacaaggtctgcaaagggttttggggctcgaggcccagacgtgctgagtccggccatggtagccctctccaacaagctgaagctgaagcgacagctggagtatgaagagcaagccttccaggacctgagcgggggggacccacctggtggcagcacctcacatttgatgtggaaacggatgaagaacctcaggggtgggagctgccctttgatgccggacaagccactgagcgcaaatgtacccaatgataagttcacccaaaaccccatgaggggcctgggccatcccctgagacatctgccgctgccacagcctccatctgccatcagtcccggggagaacagcaagagcaggttccccccacagtgctacgccacccagtaccaggactacagcctgtcgtcagcccacaaggtgtcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacgcagagcccttctcgtttcttttttaaactaatcaccatattgtaaatttcagggtttttttttttttgtttaagctgactctt

SEQ ID NO: 376689 - DNA, 2920 bp, Homo sapiens
  misc_feature (2886)..(2886): n is a, c, g, or t
cggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccaggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggctctggttttgggaaaaaaagcaaagacatgtccacagagcgggacttcttcatgaggatgaagtgcacggtcaccaacagaggccgtactgtcaacctcaagtcagccacctggaaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacagaatcacagaactgattggttaccaccctgaggagctgcttggccgctcagcctatgaattctaccatgcgctagactccgagaacatgaccaagagtcaccagaacttgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcgggaatcagaacttcgaggagtcctcagcctatggcaaggccatcctgcccccgagccagccatgggccacggagttgaggagccacagcacccagagcgaggctgggagcctgcctgccttcaccgtgccccaggcagctgccccgggcagcaccacccccagtgccaccagcagcagcagcagctgctccacgcccaatagccctgaagactattacacatctttggataacgacctgaagattgaagtgattgagaagctcttcgccatggacacagaggccaaggaccaatgcagtacccagacggatttcaatgagctggacttggagacactggcaccctatatccccatggacggggaagacttccagctaagccccatctgccccgaggagcggctcttggcggagaacccacagtccaccccccagcactgcttcagtgccatgacaaacatcttccagccactggcccctgtagccccgcacagtcccttcctcctggacaagtttcagcagcagctggagagcaagaagacagagcccgagcaccggcccatgtcctccatcttctttgatgccggaagcaaagcatccctgccaccgtgctgtggccaggccagcacccctctctcttccatggggggcagatccaatacccagtggcccccagatccaccattacattttgggcccacaaagtgggccgtcggggatcagcgcacagagttcttgggagcagcgccgttggggccccctgtctctccaccccatgtctccaccttcaagacaaggtctgcaaagggttttggggctcgaggcccagacgtgctgagtccggccatggtagccctctccaacaagctgaagctgaagcgacagctggagtatgaagagcaagccttccaggacctgagcgggggggacccacctggtggcagcacctcacatttgatgtggaaacggatgaagaacctcaggggtgggagctgccctttgatgccggacaagccactgagcgcaaatgtacccaatgctgataagttcacccaataaccccatgtaggggcctggtgcctacaatataaacgccttgctctagcctggtggatccatctacgacgtctgaccttgcatggcantgcaatgcgttggcaccttggcctgtctgtttta

SEQ ID NO: 376690 - DNA, 1614 bp, Homo sapiens
cggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccaggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggctctggttttgggaaaaaaagcaaagacatgtccacagagcgggacttcttcatgaggatgaagtgcacggtcaccaacagaggccgtactgtcaacctcaagtcagccacctggaaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacagaatcacagaactgattggttaccaccctgaggagctgcttggccgctcagcctatgaattctaccatgcgctagactccgagaacatgaccaagagtcaccagaacttgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgagtgaggtgtctccatctctgcctcaacttcatggtgcactgagctgtaacttcttccttccctattaaaattagaacctgagtataaa

SEQ ID NO: 376691 - DNA, 1672 bp, Homo sapiens
cggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccaggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggtatccttaattgtgtttacttccttcttgcccccactgggtgggaatctgcctcccctttgtctacgggtataagggagatagctcatggcccttgtgatgcaggaaaaatggatgtccttaatactcagaaatatctcctgctggccctgcatggtgcctggtgtcccactactaggggacacctttgggttaggacactgtctctaggaggtttcatcacccaagagtcaagcatctctgccaaatgacaccacccaaaccaatgaggaactagtctgtgccaaagtgctcatagtaactactgtagttatctattgctgtctaacaaaccacctataacatagggctttgatgattatctcccagggttctgtgggttcagtgggtgggtcttgtactccatgtgatgtcagctgggctgcagtcatctgggggccagactaggctggggtgatcaggatagctcacacacgtctgggaccttgtggcaggtggctggaaccctggactcagttggcatgctgggacaacaggactgttctctcactctatggagactcagagactctccctctccatatggtgtctctagggtagccagacatcttacgtggcagtttagggctcccagaagcactaaagtggaagctgccaggccttctgaaggctttgtccccagattggcagagcatcacttctgccccatcttgttggttagagca

SEQ ID NO: 376692 - DNA, 487 bp, Homo sapiens
tcagtctcctccctgcctccaaatctggaaggtggctcagcttactcttggagtcttttacttcactgttaggaataatgatgcctaaccttgtttttgaaacaggtggagctaacaggacatagtatctttgacttcactcatccctgcgaccatgaggagattcgtgagaacctgagtctcaaaaatggtatccttaattgtgtttacttccttcttgcccccactgggtgggaatctgcctcccctttgtctacgggtataagggagatagctcatggcccttgtgatgcaggaaaaatggatgtccttaaaaaatttaagtatgtagcctgtgagatgagattggggcattgagaggatccagtactcagaaatatctcctgctggccctgcatggtgcctggtgtcccactactaggggacacctttgggttaggacactgtctctaggaggtttcatcacccaagagtcaagcatctctgc

SEQ ID NO: 376693 - DNA, 461 bp, Homo sapiens
gcagcggccacaggcctgggcctcctgggggttctggtggaaggactggggctcgggagcccatcctggttcttccattcaccacaggccgtacctgcctctctgagccttgttagaatggggcgatgtcctctgtctctcccgcagtcccacacacccaacttttccatctccactctgacttagatgatgccatcagagggtcctgaaggttggctgtagttctggtgactctgagcaccttttataaaggaaagggatgctagggcttcctggcctctcccctccctcaggccaatgctaccgtcactctctgactttggtctttcagataagttcacccaaaaccccatgaggggcctgggccatcccctgagacatctgccgctgccacagcctccatctgccatcagtcccggggagaacagcaagagcaggttccccccacagtgctacgccac

SEQ ID NO: 376694 - DNA, 593 bp, Homo sapiens
gtcagcaaccccaggctcttcctgaagcttccacatacctgtgctgcagcccgcacctcacgctttcctctttcttgggtctcagcaccccacctgaggcagtggttctggaggcagacacgttccccgggcatgcagcaggccgtgggacagacaccactgaaggagcagagtgaaattagggctgctctattggtatcccccagtcacaaagaagtagacacttttccaaatgttcgatttaggcctttaagttatggtaccaacccttctttcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctga

SEQ ID NO: 376695 - DNA, 607 bp, Homo sapiens
cggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccaggagcccaggtgctcggcgtctgaacgtctcaaagggccacagcgacaatgacagctgacaaggagaagaaaagggacacaatagaagaaagcagaaggctgccatactgcaaagtgagtacgctcgtgagcaggcaggaacggaggaagatccgcgggtat

SEQ ID NO: 376696 - DNA, 3597 bp, Homo sapiens
cggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccaggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggctctggttttgggaaaaaaagcaaagacatgtccacagagcgggacttcttcatgaggatgaagtgcacggtcaccaacagaggccgtactgtcaacctcaagtcagccacctggaaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacagaatcacagaactgattggttaccaccctgaggagctgcttggccgctcagcctatgaattctaccatgcgctagactccgagaacatgaccaagagtcaccagaacttgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcgggaatcagaacttcgaggagtcctcagcctatggcaaggccatcctgcccccgagccagccatgggccacggagttgaggagccacagcacccagagcgaggctgggagcctgcctgccttcaccgtgccccaggcagctgccccgggcagcaccacccccagtgccaccagcagcagcagcagctgctccacgcccaatagccctgaagactattacacatctttggataacgacctgaagattgaagtgattgagaagctcttcgccatggacacagaggccaaggaccaatgcagtacccagacggatttcaatgagctggacttggagacactggcaccctatatccccatggacggggaagacttccagctaagccccatctgccccgaggagcggctcttggcggagaacccacagtccaccccccagcactgcttcagtgccatgacaaacatcttccagccactggcccctgtagccccgcacagtcccttcctcctggacaagtttcagcagcagctggagagcaagaagacagagcccgagcaccggcccatgtcctccatcttctttgatgccggaagcaaagcatccctgccaccgtgctgtggccaggccagcacccctctctcttccatggggggcagatccaatacccagtggcccccagatccaccattacattttgggcccacaaagtgggccgtcggggatcagcgcacagagttcttgggagcagcgccgttggggccccctgtctctccaccccatgtctccaccttcaagacaaggtctgcaaagggttttggggctcgaggcccagacgtgctgagtccggccatggtagccctctccaacaagctgaagctgaagcgacagctggagtatgaagagcaagccttccaggacctgagcgggggggacccacctggtggcagcacctcacatttgatgtggaaacggatgaagaacctcaggggtgggagctgccctttgatgccggacaagccactgagcgcaaatgtacccaatgcctccatctgccatcagtcccggggagaacagcaagagcaggttccccccacagtgctacgccacccagtaccaggactacagcctgtcgtcagcccacaaggtgtcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttttgtttaagctgactctt

SEQ ID NO: 376697 - DNA, 3375 bp, Homo sapiens
cggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccaggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggctctggttttgggaaaaaaagcaaagacatgtccacagagcgggacttcttcatgaggatgaagtgcacggtcaccaacagaggccgtactgtcaacctcaagtcagccacctggaaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacagaatcacagaactgattggttaccaccctgaggagctgcttggccgctcagcctatgaattctaccatgcgctagactccgagaacatgaccaagagtcaccagaacttgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcgggaatcagaacttcgaggagtcctcagcctatggcaaggccatcctgcccccgagccagccatgggccacggagttgaggagccacagcacccagagcgaggctgggagcctgcctgccttcaccgtgccccaggcagctgccccgggcagcaccacccccagtgccaccagcagcagcagcagctgctccacgcccaatagccctgaagactattacacatctttggataacgacctgaagattgaagtgattgagaagctcttcgccatggacacagaggccaaggaccaatgcagtacccagacggatttcaatgagctggacttggagacactggcaccctatatccccatggacggggaagacttccagctaagccccatctgccccgaggagcggctcttggcggagaacccacagtccaccccccagcactgcttcagtgccatgacaaacatcttccagccactggcccctgtagccccgcacagtcccttcctcctggacaagtttcagcagcagctggagagcaagaagacagagcccgagcaccggcccatgtcctccatcttgtctgcaaagggttttggggctcgaggcccagacgtgctgagtccggccatggtagccctctccaacaagctgaagctgaagcgacagctggagtatgaagagcaagccttccaggacctgagcgggggggacccacctggtggcagcacctcacatttgatgtggaaacggatgaagaacctcaggggtgggagctgccctttgatgccggacaagccactgagcgcaaatgtacccaatgcctccatctgccatcagtcccggggagaacagcaagagcaggttccccccacagtgctacgccacccagtaccaggactacagcctgtcgtcagcccacaaggtgtcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttttgtttaagctgactctt

SEQ ID NO: 376698 - DNA, 1279 bp, Homo sapiens
ttgccaggctggagtgcagtggctattcacaggcgcgatcccactactgatcagcacgggagttttgacctgctccgtttccgacctgtccttgttattctgttgtgaccacacatttgactgctgtcaggatgtttatgctttgggtttcactggtcaaggtcatccttcatgttctcttcagagaggtttcatttgacacaaatgctaggtactccctaaaagctgaagctgaagcgacagctggagtatgaagagcaagccttccaggacctgagcgggggggacccacctggtggcagcacctcacatttgatgtggaaacggatgaagaacctcaggggtgggagctgccctttgatgccggacaagccactgagcgcaaatgtacccaatgataagttcacccaaaaccccatgaggggcctgggccatcccctgagacatctgccgctgccacagcctccatctgccatcagtcccggggagaacagcaagagcaggttccccccacagtgctacgccacccagtaccaggactacagcctgtcgtcagcccacaaggtgtcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttttgtttaagctgactctt

SEQ ID NO: 376699 - DNA, 1725 bp, Homo sapiens
cggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccaggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggtatccttaattgtgtttacttccttcttgcccccactgggtgggaatctgcctcccctttgtctacgggtataagggagatagctcatggcccttgtgatgcaggaaaaatggatgtccttaaaaaatttaagtatgtagcctgtgagatgagattggggcattgagaggatccagtactcagaaatatctcctgctggccctgcatggtgcctggtgtcccactactaggggacacctttgggttaggacactgtctctaggaggtttcatcacccaagagtcaagcatctctgccaaatgacaccacccaaaccaatgaggaactagtctgtgccaaagtgctcatagtaactactgtagttatctattgctgtctaacaaaccacctataacatagggctttgatgattatctcccagggttctgtgggttcagtgggtgggtcttgtactccatgtgatgtcagctgggctgcagtcatctgggggccagactaggctggggtgatcaggatagctcacacacgtctgggaccttgtggcaggtggctggaaccctggactcagttggcatgctgggacaacaggactgttctctcactctatggagactcagagactctccctctccatatggtgtctctagggtagccagacatcttacgtggcagtttagggctcccagaagcactaaagtggaagctgccaggccttctgaaggctttgtccccagattggcagagcatcacttctgccccatcttgttggttagagca

SEQ ID NO: 376700 - DNA, 1008 bp, Homo sapiens
cggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccaggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagcagtgacctttaccgtgaatccagctgtgagaggagggcagggacaggaccagggaagaacatgggcacccagaggctgtggagaacacgggctgggagaaccaaggacggcttttgctgacttctcaatttgttgccatctggccataagacccatcctccacactagattgagtccgcaggaagcattctaatccttaacttccagtgccttctccagaacagcaagaaggtgtgcccggatgatcttttccctctgagaagccagttaggccaagtaaatcatttagtctctctg

SEQ ID NO: 376701 - DNA, 372 bp, Homo sapiens
gtagttgagaccacagatgtaccccaccacactcagctaatttttgtatttttagtagagacgggggtttcaccatgtttcccaggctggtcttaaactcctgagctcaaacgatccccctacgttggcctcctaaagtgctgggactacaggtgtgagccactgtgcctggccttaattcagcaaacatttccatgaaaggttttcttcatgcctggtactgtgctcagactttgggatacaaaaacaaacaaacaaaaaaactcacagtcttggctttttttttttgagacggagtcactctctcttccccaggctggagtgcaatggtgcgatctctgctcaatgcaacctccacctcccaggctcaag

SEQ ID NO: 376702 - DNA, 460 bp, Homo sapiens
cgccatatatgaacatatgtgataacgaatggtgtggaaagtttggtgtttctgcatgatcatgattctcttacttaaaaagttaataccactaagtggtaaaaagacagataaggctaacgtccacagggaagtctattatggaaaagagaagagcaaggtgggtggatgaattaaaaattaaaatactacctcattctgagtattttttaaaatttaaaccacattatgcacttattcttgacttactactctgatccatttattaataactgaatgagatagccctgacatcttttcttctgtaaatacaaaatcaaatgaatcagacgttattcataaattaaaaacatgagactataatatctagtgcttatcacaataaacatggaacatgtttctgaaaattggaagtcagaatgatttgatcattaagccctaatttcagatggaaataaaa

SEQ ID NO: 376703 - DNA, 402 bp, Homo sapiens
actatagattatcttatttcctcctaagggtttaaaagtgaaaactccagccaaaggagtgattagtggattggcctcagacagggattcactaaggggtctgtgatccctggattctcagtcctcacatggccggaaccaacatagatgaggctggccttggcccctcccagtacgtatgaccaaacattttcccaaaggaaaatgagcccacagccaaataactggacagttgaggaggaaaagtctacacaagcagcacgtatcatctgatcacacatgttgaagcagaaggtcccaaaatctaataatgctccttaaataggagacaagagaaaatgttagcaatatgcagcaagaacaagatatcattaaaacaaactaagtgaaaatattaggtag

SEQ ID NO: 376704 - DNA, 519 bp, Homo sapiens
gtttttttctagttttttttttcctgctacaaacaatgctgcaacaaacactcttatgcataaacccttagaagccagtgcttttgttggatagattcccaggagtgtttattgctatgttaaatggtatgtgtacattttattctaatagatcttaccagattgtagacagtagattttaagtaagttgatttttaaaaaaataaaaagcagaatcccatagagctgctaaaattctcatttccttattcctttccagagaatctccttcattatctttgagacaaacatgagcaaaatccatttatttatttcaacagataatctatgatgaagaatttcaggaatttatttgccacaaagagatagcaattcacgggccaaacagttgagtaagtgccccttaaatcacaaagtaacccaagtaacctggcattttgtgcatatatcctcttacttctgttttgctagaggcagtaggactagggtggcatgctggtggccaaaccacaccactgg

SEQ ID NO: 376705 - DNA, 342 bp, Homo sapiens
ggttcaagcaattctctgcctcagcctcctgagtagctgggattacaggcacccaccaccatgcccagctaatttttgtatttttagtagagatggggtaacaccatcttggccaagctggtcttgaactcctgacctcataatctacccacctcggcctcccaaagtgccgagattacaggcatgagccaccacgcccggcctggagcaccattttttttttttttaaagcagaatacatactttattctttaaaatttcttctctctttttttttaaactttttttagtatttattgatcattcttgggtgtttctcgagagggggaatttggcagggtc

SEQ ID NO: 376706 - DNA, 170 bp, Homo sapiens
gcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacatggaga

SEQ ID NO: 376707 - DNA, 210 bp, Homo sapiens
actagtccacggttggctactagtccacggttggctactagtccacggttggctactagtccacggttggctactagtccacggttggctggaagtaccaggcagtgacagccaccctggaggagaagaggaaagagaaagccaagatccactaccggaagaagaaacagctcatgaggctacggaaacaggccgagaagaacatggaga

SEQ ID NO: 376708 - DNA, 361 bp, Homo sapiens
catccccattgctgcctcctcaaaccagagcataaccatccctacgtcggttcatccagtacttcctagctggtcctcttgctctgttcactcttgcctctgttcaatctattctctccacagtactcagaattcttcaaatataagtcaaatcattcttaaagcactctaggaaattcttaatgctatttaaagtggaccataaagcctttcttgatctgctccctgcctgttttttcatcctctcttttgccctctctcctgccagggctgtcacacgtggtgtctcctttgtctgtggcattgttctcactgtgggttctcagctggttaattcatactaaaccttctggcctcaact

SEQ ID NO: 376709 - DNA, 1596 bp, Homo sapiens
agcggggtgctgggcgggaggcgcacgcgcagaactgttggccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggtcacctaaatactcatattctcgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttgaaataacagcataaggaacttcactgtctctgctcaataaaatacctgtaactgga

SEQ ID NO: 376710 - DNA, 1634 bp, Homo sapiens
agcggggtgctgggcgggaggcgcacgcgcagaactgttggccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagtaacctctctgccctgctttctgaaattgctataacagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggtcacctaaatactcatattctcgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttgaaataacagcataaggaacttcactgtctctgctcaataaaatacctgtaactgga

SEQ ID NO: 376711 - DNA, 1476 bp, Homo sapiens
agcggggtgctgggcgggaggcgcacgcgcagaactgttggccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggtcacctaaatactcatattctcgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttgaaataacagcataaggaacttcactgtctctgctcaataaaatacctgtaactgga

SEQ ID NO: 376712 - DNA, 1539 bp, Homo sapiens
gggcactcgacgatacgtactgcaagggaaaacccggagtggactgtgtcattggtgaatactgcgtgcttccttatcgaacgtatctctagggtcgatgacctgaagtaggcctcgagactatcctcaaggccatagtaaactcatgtgaccccagtgttgggcaagcacatggcagatgtcttgaatgcaatactgctaggatcgagtaggttttctcgcagagatgctctctagcgtaggcaatctagtcagcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcaggtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggtcacctaaatactcatattctcgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttgaaataacagcataaggaacttcactgtctctgctcaataaaatacctgtaactgga

SEQ ID NO: 376713 - DNA, 1695 bp, Homo sapiens
agcggggtgctgggcgggaggcgcacgcgcagaactgttggccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcagcgttgcatatttaggagtaagaagtttttcctcggtaatgctgttcagtttttcttcatgacttccaaatatggcaccatgtgtgcacttctgattcttgtgtaaaatactagacagacatctggcaatattgtccaagaaacacctcgagaccaaatttttgaagctgaatgtggaaaaagcacctttcctttgtgagagactgcatatcaaagtcattcccacactagcactgctaaaagatgggaaaacacaagattatgttgttgggtttactgacctaggaaatacagatgacttcaccacagaaactttagaatggaggctcggttcttctgacattcttaattacagtggaaatttaatggagccaccatttcagaaccaaaagaaatttggaacaaacttcacaaagctggaaaagaaaactatccgaggaaagaaatatgattcagactctgatgatgattagagctcaataattctttgtaaattgtctttttttttctgcttcagatttaaatgtgtttttaaaattctattaatgtctatacattggtcacctaaatactcatattctcgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttgaaataacagcataaggaacttcactgtctctgctcaataaaatacctgtaactgga

SEQ ID NO: 376714 - DNA, 636 bp, Homo sapiens
  misc_feature (572)..(572): n is a, c, g, or t
  misc_feature (619)..(619): n is a, c, g, or t
  misc_feature (633)..(633): n is a, c, g, or t
agcggggtgctgggcgggaggcgcacgcgcagaactgttggccacccgaccgcccgccccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagaaacaagaatggctttctaaaggacatggggaatacagagaaatccctagtgaaagagacttttttcaagaagtcaaggagagtgaaaatgtggtttgccatttctacagagactccacattcagagacancatctggcatatgtccagaacactcggaccttttgagcgatgtggcncttccttttgaggnggc
